US012807928B2

(12) United States Patent
Fernandez Santidrian et al.

(10) Patent No.: US 12,807,928 B2
(45) **Date of Patent: *Nov. 24, 2026**

(54) ENHANCED SYSTEMS FOR CELL-MEDIATED ONCOLYTIC VIRAL THERAPY

(71) Applicant: CALIDI BIOTHERAPEUTICS (NEVADA), INC., San Diego, CA (US)

(72) Inventors: Antonio Fernandez Santidrian, San Diego, CA (US); Duong Hoang Nguyen, San Diego, CA (US); Dobrin Draganov, San Diego, CA (US)

(73) Assignee: Calidi Biotherapeutics (Nevada), Inc., San Diego, CA (US)

( * ) Notice: Subject to any disclaimer, the term of this patent is extended or adjusted under 35 U.S.C. 154(b) by 844 days.

This patent is subject to a terminal disclaimer.

(21) Appl. No.: 18/295,171

(22) Filed: Apr. 3, 2023

(65) Prior Publication Data

US 2023/0265392 A1 Aug. 24, 2023

Related U.S. Application Data

(63) Continuation of application No. 16/676,413, filed on Nov. 6, 2019, now Pat. No. 11,655,455.

(60) Provisional application No. 62/789,458, filed on Jan. 7, 2019, provisional application No. 62/756,550, filed on Nov. 6, 2018.

(51) Int. Cl.

| | |
|---|---|
| ***C12N 5/0775*** | (2010.01) |
| ***A61K 35/28*** | (2015.01) |
| ***A61P 35/00*** | (2006.01) |
| ***C12N 7/00*** | (2006.01) |
| ***C12N 15/86*** | (2006.01) |

(52) U.S. Cl.

CPC ............ *C12N 5/0667* (2013.01); *A61K 35/28* (2013.01); *A61P 35/00* (2018.01); *C12N 7/00* (2013.01); *C12N 15/86* (2013.01); *C12N 2710/10343* (2013.01); *C12N 2710/24122* (2013.01); *C12N 2710/24133* (2013.01)

(58) Field of Classification Search

None

See application file for complete search history.

(56) References Cited

U.S. PATENT DOCUMENTS

| | | | | |
|---|---|---|---|---|
| 5,023,252 | A | 6/1991 | Hseih | 514/183 |
| 5,716,613 | A | 2/1998 | Guber et al. | 424/93.2 |
| 5,716,826 | A | 2/1998 | Gruber et al. | 435/320.1 |
| 5,851,529 | A | 12/1998 | Guber et al. | 424/188.1 |
| 6,428,968 | B1 | 8/2002 | Molnar-Kimber et al. | 435/7.23 |
| 6,632,670 | B1 | 10/2003 | Wadsworth et al. | 435/455 |
| 6,635,472 | B1 | 10/2003 | Lauermann | 435/320.1 |
| 6,653,103 | B2 | 11/2003 | Petersen et al. | 435/69.1 |
| 6,689,871 | B1 | 2/2004 | Wolfe et al. | 530/412 |
| 6,723,316 | B2 | 4/2004 | Laquerre et al. | 424/93.2 |
| 6,723,325 | B1 | 4/2004 | Weltzin et al. | 424/232.1 |
| 6,897,045 | B2 | 5/2005 | Engelhardt et al. | 435/69.6 |
| 7,001,765 | B2 | 2/2006 | Maass | 435/320.1 |
| 7,033,826 | B2 | 4/2006 | Perricaudet et al. | 435/320.1 |
| 7,115,270 | B2 | 10/2006 | Weltzin et al. | 424/232.1 |
| 7,153,510 | B1 | 12/2006 | Rose | 424/199.1 |
| 7,172,893 | B2 | 2/2007 | Rabinowitz et al. | 435/235.1 |
| 7,238,526 | B2 | 7/2007 | Wilson et al. | 435/382 |
| 7,241,447 | B1 | 7/2007 | Engelhardt et al. | 424/193.1 |
| 7,537,924 | B2 | 5/2009 | Coffin | 435/235.1 |
| 7,550,296 | B2 | 6/2009 | Hermiston et al. | 435/473 |
| 7,588,767 | B2 | 9/2009 | Szalay et al. | 424/199.1 |
| 7,588,771 | B2 | 9/2009 | Szalay et al. | 424/232.1 |
| 7,645,456 | B2 | 1/2010 | Weltzin et al. | 424/232.1 |
| 7,662,398 | B2 | 2/2010 | Szalay et al. | 424/232.1 |
| 7,662,627 | B2 | 2/2010 | Johnson, Jr. | 435/367 |
| 7,731,952 | B2 | 6/2010 | Mohr et al. | 424/93.2 |
| 7,731,974 | B2 | 6/2010 | Bell et al. | 424/199.1 |
| 7,754,221 | B2 | 7/2010 | Szalay et al. | 424/199.1 |
| 7,811,814 | B2 | 10/2010 | Bohn et al. | 435/320.1 |
| 7,897,146 | B2 | 3/2011 | Brown et al. | 424/93.1 |
| 7,906,111 | B2 | 3/2011 | Wilson et al. | 424/93.2 |
| 7,927,585 | B2 | 4/2011 | Snyder | 424/93.2 |
| 7,943,374 | B2 | 5/2011 | Hildinger | 435/320.1 |
| 7,968,340 | B2 | 6/2011 | Hallek et al. | 435/440 |
| 8,007,780 | B2 | 8/2011 | Arbetman et al. | 424/93.2 |
| 8,021,662 | B2 | 9/2011 | Szalay et al. | 424/138.1 |
| 8,052,968 | B2 | 11/2011 | Chen et al. | 424/93.21 |
| 8,221,769 | B2 | 7/2012 | Szalay et al. | 424/232.1 |
| 8,445,275 | B2 | 5/2013 | Hochrein et al. | 435/372 |
| 8,691,502 | B2 | 4/2014 | Kupper et al. | 435/5 |
| 8,859,256 | B2 | 10/2014 | Szalay et al. | 435/210 |

(Continued)

FOREIGN PATENT DOCUMENTS

| | | | |
|---|---|---|---|
| CN | 1839201 | A | 9/2006 |
| CN | 101194012 | A | 6/2008 |

(Continued)

OTHER PUBLICATIONS

Letter/Written Disclosure of the Supplemental Information Disclosure Statement for the above-referenced application, filed herewith on Feb. 14, 2024, 2 pages.

Furness, G. and J.S. Youngner "One-Step Growth Curves for Vaccinia Virus in Cultures of Monkey Kidney Cells," Virology 9:386-395 (1959).

Examiner's Report, issued Feb. 6, 2024, in connection with Australian Patent Application No. 2019377141; [D1: Willmon et al., "Cell carriers for oncolytic viruses: Fed Ex for cancer therapy," Molecular Therapy 17(10):1667-1676 (2009)], 3 pages.

(Continued)

*Primary Examiner* — Robert M Kelly

(74) *Attorney, Agent, or Firm* — Womble Bond Dickinson (US) LLP; Stephanie Seidman

(57) ABSTRACT

Provided herein are enhanced systems for potentiating cell-mediated oncolytic viral therapy. Also provided are modified viruses for such systems, and methods of treatment of cancers by administering such systems.

44 Claims, No Drawings

Specification includes a Sequence Listing.

(56) References Cited

U.S. PATENT DOCUMENTS

| | | | | |
|---|---|---|---|---|
| 9,492,534 | B2 | 11/2016 | Szalay et al. | 424/199.1 |
| 10,105,436 | B2 | 10/2018 | Szalay et al. | 424/186.1 |
| 11,505,782 | B2 | 11/2022 | Draganov et al. | 424/93.21 |
| 11,655,455 | B2 | 5/2023 | Fernandez Santidrian et al. | 424/93.21 |
| 12,036,278 | B2 | 7/2024 | Szalay et al. | 424/232.1 |
| 2002/0168344 | A1 | 11/2002 | Coffey et al. | 424/93.2 |
| 2004/0009604 | A1 | 1/2004 | Zhang et al. | 435/456 |
| 2004/0234455 | A1 | 11/2004 | Szalay | 424/9.6 |
| 2005/0220818 | A1 | 10/2005 | Lorence | 424/214.1 |
| 2005/0260601 | A1 | 11/2005 | Whitt et al. | 435/6 |
| 2006/0039894 | A1 | 2/2006 | Mohr et al. | 424/93.6 |
| 2007/0077231 | A1 | 4/2007 | Contag et al. | 424/93.2 |
| 2007/0098743 | A1 | 5/2007 | Bell | 424/224.1 |
| 2007/0110720 | A1 | 5/2007 | Brown et al. | 424/93.2 |
| 2009/0010889 | A1 | 1/2009 | Brown et al. | 424/93.2 |
| 2009/0162288 | A1 | 6/2009 | Chen et al. | 424/9.3 |
| 2009/0215147 | A1 | 8/2009 | Zhang et al. | 435/235.1 |
| 2009/0274728 | A1 | 11/2009 | Brown et al. | 424/231.1 |
| 2009/0285860 | A1 | 11/2009 | Martuza et al. | 424/277.1 |
| 2010/0092515 | A1 | 4/2010 | Conner et al. | 424/231.1 |
| 2010/0113567 | A1 | 5/2010 | Barber | 514/44 R |
| 2010/0172877 | A1 | 7/2010 | van den Pol et al. | 424/93.6 |
| 2010/0178684 | A1 | 7/2010 | Woo et al. | 435/235.1 |
| 2010/0297072 | A1 | 11/2010 | DePinho | 424/85.2 |
| 2011/0064650 | A1 | 3/2011 | Szalay | 424/1.11 |
| 2011/0158948 | A1 | 6/2011 | Brown et al. | 424/93.2 |
| 2011/0177032 | A1 | 7/2011 | Martuza et al. | 424/93.2 |
| 2011/0212530 | A1 | 9/2011 | Baltimore et al. | 435/455 |
| 2011/0293527 | A1 | 12/2011 | Chen et al. | 424/9.3 |
| 2012/0087901 | A1 | 4/2012 | Nelson | 424/93.21 |
| 2013/0273007 | A1 | 10/2013 | Szalay et al. | 424/93.2 |
| 2017/0043010 | A1 | 2/2017 | Szalay et al. | 424/186.1 |
| 2017/0239338 | A1 | 8/2017 | Szalay et al. | 424/93.2 |
| 2018/0092951 | A1 | 4/2018 | Szalay et al. | 424/138.1 |
| 2018/0326048 | A1 | 11/2018 | Szalay et al. | 424/186.1 |
| 2019/0367880 | A1 | 12/2019 | Draganov et al. | 424/93.21 |
| 2020/0140824 | A1 | 5/2020 | Fernandez Santidrian et al. | 424/93.21 |
| 2020/0318073 | A9 | 10/2020 | Draganov et al. | 424/93.21 |
| 2022/0241388 | A1 | 8/2022 | Szalay et al. | 424/93.2 |

FOREIGN PATENT DOCUMENTS

| | | | |
|---|---|---|---|
| CN | 104427992 | A | 3/2015 |
| CN | 108135996 | A | 6/2018 |
| EP | 1520175 | | 11/2007 |
| EP | 1606411 | | 12/2008 |
| EP | 1385466 | | 3/2011 |
| JP | 2011-078427 | | 4/2011 |
| JP | 2018-527344 | | 9/2018 |
| JP | 2022-520298 | | 3/2022 |
| WO | WO 2002/046455 | | 6/2002 |
| WO | WO 2004/014314 | | 2/2004 |
| WO | WO 2004/085659 | | 10/2004 |
| WO | WO 2005/047458 | | 5/2005 |
| WO | WO 2006/108846 | | 10/2006 |
| WO | WO 2008/009115 | | 1/2008 |
| WO | WO 2008/052054 | | 5/2008 |
| WO | WO 2008/134878 | | 11/2008 |
| WO | WO 2009/139921 | | 11/2009 |
| WO | WO 2011/070974 | | 6/2011 |
| WO | WO 2011/119628 | | 9/2011 |
| WO | WO 2012/061120 | | 5/2012 |
| WO | WO 2013/112942 | | 8/2013 |
| WO | WO 2014/022138 | | 2/2014 |
| WO | WO 2015/089280 | | 6/2015 |
| WO | WO 2016/008976 | | 1/2016 |
| WO | WO 2016/065330 | | 4/2016 |
| WO | WO 2016/149559 | | 9/2016 |
| WO | WO 2017/027757 | | 2/2017 |
| WO | WO 2018/064762 | | 4/2018 |
| WO | WO 2018/195552 | | 10/2018 |
| WO | WO 2019/236633 | A2 | 12/2019 |
| WO | WO 2019/236633 | A3 | 3/2020 |
| WO | WO 2020/097269 | | 5/2020 |

OTHER PUBLICATIONS

Response, filed Nov. 7, 2023, to Examiner's Report, issued Jul. 7, 2023, in connection with Canadian Patent Application No. 3116192, 78 pages.

Examiner's Report, issued Jan. 15, 2024, in connection with Canadian Patent Application No. 3116192; [D10: WO 2016/008976], 5 pages.

Response to Office Action issued Jul. 6, 2023, in connection with Chinese Patent Application No. 201980088066.X [English instructions for Response, English translation of filed claims, and Response as filed in Chinese], received on Dec. 11, 2023, 50 pages.

Office Action, issued Nov. 28, 2023, in connection with Eurasian Patent Application No. 202100155 [English translation and original documents as issued in Russian; D1 = Ahmed et al., Mol. Pharm. 8(5):1559-1572 (2011); D2= Moreno et al., Stem Cells International 2017: 3615729 (2017); D3= Kim et al., Viruses 7(12): 6200-6217 (2015); D4= Rincon et al., Oncotarget 8(28):45415-45431 (2017); D5= Guo et al., Gene Ther. 17(12):1465-1475 (2010); D6= Mader et al., Clin. Cancer Res. 15(23):7246-7255 (2009); D7= Roy, D. G. and J. C. Bell, Oncolytic Virother. 2:47-56 (2013); D11= G. Furness and J.S. Youngner, Virology, 9 (1959)], 10 pages.

Letter/Written Disclosure of the Supplemental Information Disclosure Statement for the above-referenced application, filed herewith on Dec. 4, 2024, 3 pages.

Response, filed Apr. 23, 2024, to Examiner's Report, issued Feb. 6, 2024, in connection with Australian Patent Application No. 2019377141, 32 pages.

Notice of Allowance, mailed May 28, 2024, in connection with Australian Patent Application No. 2019377141, 3 pages.

Response, filed May 14, 2024, to Examiner's Report, issued Jan. 15, 2024, in connection with Canadian Patent Application No. 3,116,192, 41 pages.

Office Action, issued Feb. 1, 2024, in connection with Chinese Patent Application No. 201980088006.X [English language translation and Office Action as issued in Chinese; D1: CN108135996A, D2: CN101194012A], 14 pages.

Response to Office Action issued Feb. 1, 2024, in connection with Chinese Patent Application No. 201980088006.X [English instructions for Response, English translation of filed claims, and Response as filed in Chinese], received on Jun. 6, 2024, 54 pages.

Decision of Rejection, issued Jun. 22, 2024, in connection with Chinese Patent Application No. 201980088006.X [English language translation and Office Action as issued in Chinese; D1: CN108135996A, D2: CN101194012A], 16 pages.

Response, filed Sep. 23, 2024, to Decision of Rejection, issued Jun. 22, 2024, in connection with Chinese Patent Application No. 201980088006.X [English instructions for response; Response as filed in Chinese; and English language translation of claims as filed], 56 pages.

Office Action, issued Oct. 1, 2024, in connection with Japanese Patent Application No. 2023-128476 [English language translation and original Office Action as issued in Japanese], 9 pages.

Office Action, issued Oct. 31, 2024, in connection with Korean Patent Application No. 10-2021-7017256 [English language translation and original Office Action as issued in Korean], 7 pages.

Zimmerlin et al., "Stromal vascular progenitors in adult human adipose tissue," Cytometry Part A 77A: 22-30 (2010).

Letter/Written Disclosure of the Supplemental Information Disclosure Statement for the above-referenced application, filed herewith on Sep. 12, 2023, 2 pages.

Examiner's Report, issued Jul. 7, 2023, in connection with Canadian Patent Application No. 3116192, 4 pages.

Office Action, issued Jul. 6, 2023, in connection with Chinese Patent Application No. 201980088066.X [Office Action as issued in Chinese and English translation], 16 pages.

(56) References Cited

OTHER PUBLICATIONS

Decision to Grant, issued Jul. 11, 2023, in connection with Japanese Patent Application No. 2021-523930 [English letter and origianl document in Japanese], 5 pages.
Letter/Written Disclosure of the Information Disclosure Statement for the above-referenced application, filed herewith on May 18, 2023, 2 pages.
Agranovski et al., "Rapid detection of airborne viruses by personal bioaerosol sampler combined with the PCR device," Atmospheric Environment 40:3924-3929 (2006).
Ahmed et al., "A Comparative Study of Neural and Mesenchymal Stem Cell-Based Carriers for Oncolytic Adenovirus in a Model of Malignant Glioma," Mol. Pharm. 8(5):1559-1572 (2011).
Albarnaz et al., "Modulating Vaccinia Virus Immunomodulators to Improve Immunological Memory," Viruses 10(3):101 (2018), 33 pages.
Almazan et al., "An oligodendrocyte precursor cell line from rat optic nerve," Brain Res. 579:234-245 (1992).
Angelova et al., "The Oncolytic Virotherapy Era in Cancer Management: Prospects of Applying H-1 Parvovirus to Treat Blood and Solid Cancers," Front. Oncol. 7:93 (2017), 8 pages.
Angelova et al., "Tumor Selectivity of Oncolytic Parvoviruses: From in vitro and Animal Models to Cancer Patients," Frontiers in Bioengineering and Biotechnology 3:55 (2015), 14 pages].
Aref et al., "Measles to the Rescue: A Review of Oncolytic Measles Virus," Viruses 8:294 (2016), 16 pages.
Bahar et al., "How vaccinia virus has evolved to subvert the host immune response," J. Struct. Biol. 175(2-2):127-134 (2011).
Balvers et al., "Locally-delivered T-cell-derived cellular vehicles efficiently track and deliver adenovirus Delta24-RGD to infiltrating glioma," Viruses 6:3080-3096 (2014).
Barnett et al., "In vitro and in vivo analysis of a rat bipotential O-2A progenitor cell line containing the temperature-sensitive mutant gene of the SV40 large T antigen," Eur. J. Neurosci. 5:1247-1260 (1993).
Baroudy et al., "Incompletely base-paired flip-flop terminal loops link the two DNA strands of the vaccinia virus genome into one uninterrupted polynucleotide chain," Cell 28:315-324 (1982).
Bendjama, K. and E. Quemeneur, "Modified Vaccinia virus Ankara-based vaccines in the era of personalized immunotherapy of cancer," Human Vaccines & Immunotherapeutics 13(9):1997-2003 (2017).
Bishnoi et al., "Oncotargeting by Vesicular Stomatitis Virus (VSV): Advances in Cancer Therapy," Viruses 10(2):90 (2018) [20 pages].
Bolontrade et al., "A specific subpopulation of mesenchymal stromal cell carriers overrides melanoma resistance to an oncolytic adenovirus," Stem cells and development 21(14):2689-2702 (2012).
Bourin et al., "Stromal cells from the adipose tissue-derived stromal vascular fraction and culture expanded adipose tissue-derived stromal/stem cells: a joint statement of the International Federation for Adipose Therapeutics and Science (IFATS) and the International Society for Cellular Therapy (ISCT)," Cytotherapy 15(6):641-648 (2013).
Bradley et al., "Applications of coxsackievirus A21 in oncology," Oncolytic Virotherapy 3:47-55 (2014).
Broder, C.C. and P.L. Earl, "Recombinant vaccinia viruses. Design, generation, and isolation," Mol. Biotechnol. 13:223-245 (1999).
Brown, M.C. and M. Gromeier, "Oncolytic immunotherapy through tumor-specific translation and cytotoxicity of poliovirus," Discov. Med. 19(106):359-365 (2015).
Brown, M.C. and M. Gromeier, "Cytotoxic and immunogenic mechanisms of recombinant oncolytic poliovirus," Curr. Opin. Virol. 13:81-85 (2015).
Brown et al., "Oncolytic polio virotherapy of cancer," Cancer 120(21):3277-3286 (2014).
Brun et al., "Identification of genetically modified Maraba virus as an oncolytic rhabdovirus," Mol. Ther. 18(8):1440-1449 (2010).
Burke, M. J., "Oncolytic Seneca Valley Virus: past perspectives and future directions," Oncolytic Virotherapy 5:81-89 (2016).
Burke et al., "Phase I Trial of Seneca Valley Virus (NTX-010) in Children with Relapsed / Refractory Solid Tumors: A Report of the Children's Oncology Group," Pediatr. Blood Cancer 62(5):743-750 (2015).
Bykov et al., "Virus, Vessel, Victory: A Novel Approach to Tumor Killing," Clin. Cancer Res. 25(5):1446-1448 (2019).
Campadelli-Fiume et al., "Retargeting Strategies for Oncolytic Herpes Simplex Viruses," Viruses 8(3):63 (2016), 11 pages.
Casteilla et al., "Adipose-derived stromal cells: Their identity and uses in clinical trials, an update," World J. Stem Cells 3(4):25-33 (2011).
Cattaneo et al., "Reprogrammed viruses as cancer therapeutics: targeted, armed and shielded," Nat. Rev. Microbiol. 6(7):529-540 (2008).
Cecil et al., "Vaccinia virus injected human tumors: oncolytic virus efficiency predicted by antigen profiling analysis fitted boolean models," Bioengineered 10(1):190-96 (2019).
W. M. Chan and G. McFadden, "Oncolytic Poxviruses," Annu. Rev. Virol. 1(1): 119-141 (2014).
Chen et al., "A Novel Recombinant Vaccinia Virus Expressing the Human Norepinephrine Transporter Retains Oncolytic Potential and Facilitates Deep-Tissue Imaging," Mol. Med. 15(5-6): 144-151 (2009).
Cheng et al., "Genetic Modification of Oncolytic Newcastle Disease Virus for Cancer Therapy," J. Virol. 90(1):5343-5352 (2016).
Chkhidze ct al., "Identification of DNA binding proteins in vaccinia virus by DNA-protcin crosslinking," FEBS 336(2):340-342 (1993).
Choi et al., "Polymeric oncolytic adenovirus for cancer gene therapy," J. Control. Release 219:181-191 (2015).
Clinical Trial: "Administration of VSV-IFNß-NIS Monotherapy and in Combination With Avelumab in Patients With Refractory Solid Tumors," ClinicalTrials.gov identifier NCT02923466; study first posted on Oct. 4, 2016; last update posted on Dec. 17, 2019; retrieved from <URL: clinicaltrials.gov/ct2/show/NCT02923466?term=NCT02923466&draw=2&rank=1 [retrieved on Jan. 8, 2020], 6 pages.
Clinical Trial: "Phase 1 Trial of Interleukin 12 Gene Therapy for Metastatic Pancreatic Cancer," ClinicalTrials.gov identifier NCT03281382; study first posted on Sep. 13, 2017; last update posted on Sep. 13, 2017; retrieved from <URL: clinicaltrials.gov/ct2/show/NCT03281382?term=NCT03281382&draw=2&rank=1 [retrieved on Jan. 8, 2020], 7 pages.
Clinical Trial: "VSV-hIFNbeta-NIS in Treating Patients With Relapsed or Refractory Multiple Myeloma, Acute Myeloid Leukemia, or T-cell Lymphoma," ClinicalTrials.gov identifier NCT03017820; study first posted on Jan. 11, 2017; last update posted on Dec. 30, 2019; retrieved from <URL: clinicaltrials.gov/ct2/show/NCT03017820?term=NCT03017820&draw=2&rank=1 [retrieved on Jan. 8, 2020], 12 pages.
Clinical Trial: "VSV-hIFNbeta-NIS in Treating Patients With Stage IV or Recurrent Endometrial Cancer," ClinicalTrials.gov identifier NCT03120624; study first posted on Apr. 19, 2017; last update posted on Aug. 6, 2019; retrieved from <URL: clinicaltrials.gov/ct2/show/NCT03120624?term=NCT03120624&draw=2&rank=1 [retrieved on Jan. 8, 2020], 11 pages.
Dahmani, A. and J.S. Delisle, "TGF-β in T Cell Biology: Implications for Cancer Immunotherapy," Cancers 10: 194 (2018), 21 pages.
Deng et al., "Irradiation and anti-PD-L 1 treatment synergistically promote antitumor immunity in mice," J Clin Invest 124(2):687-695 (2014).
Dold et al., "Application of interferon modulators to overcome partial resistance of human ovarian cancers to VSV-GP oncolytic viral therapy," Molecular Therapy—Oncolytics 3:16021 (2016), 11 pages.
Dorer, D.E. and D.M. Nettelbeck, "Targeting cancer by transcriptional control in cancer gene therapy and viral oncolysis," Adv. Drug Deliv. Rev. 61(7-8):554-571 (2009).
Draganov ct al., "Delivery of oncolytic vaccinia virus by matched allogencic stem cells overcomes critical innate and adaptive immune barriers," J. Transl. Med. 17(1): 100 (2019), 22 pages.

(56) References Cited

OTHER PUBLICATIONS

Draghiciu et al., "Therapeutic immunization and local low-dose tumor irradiation, a reinforcing combination," Int. J. Cancer 134: 859-872 (2014).
Eissa et al., "Genomic Signature of the Natural Oncolytic Herpes Simplex Virus HF10 and Its Therapeutic Role in Preclinical and Clinical Trials," Front. Oncol. 7:149 (2017) [12 pages].
Falkner, F.G. and B. Moss, "Transient dominant selection of recombinant vaccinia viruses," J. Virol. 64(6): 3108-11 (1990).
Fares et al., "Neural stem cell delivery of an oncolytic adenovirus in newly diagnosed malignant glioma: a first-in-human, phase 1, dose-escalation trial," Lancet Oncol. 22:1103-1114 (2021).
Felt, S.A. and V.Z. Grdzelishvili, "Recent advances in vesicular stomatitis virus-based oncolytic virotherapy: a 5-year update," Journal of General Virology 98:2895-2911 (2017).
Fu et al., "Effective treatment of pancreatic cancer xenografts with a conditionally replicating virus derived from type 2 herpes simplex virus," Clin. Cancer Res. 12(10):3152-3157 (2006).
Fujiwara et al., "Carrier cell-based delivery of replication-competent HSV-1 mutants enhances antitumor effect for ovarian cancer," Cancer Gene Therapy 18:77-86 (2011).
Fung, M.K.L. and G.C. Chan, "Drug-induced amino acid deprivation as strategy for cancer therapy," Journal of Hematology & Oncology 10:144 (2017), 18 pages.
Gardner et al., "Vaccinia virus semaphorin A39R is a 50-55 kDa secreted glycoprotein that affects the outcome of infection in a murine intradermal model," J. Gen. Virol. 82:2083-2093 (2001).
Geiss et al., "Preclinical Testing of an Oncolytic Parvovirus: Standard Protoparvovirus H-1PV Efficiently Induces Osteosarcoma Cell Lysis In Vitro," Viruses 9:301 (2017), 18 pages.
Geletneky et al., "Oncolytic H-1 Parvovirus Shows Safety and Signs of Immunogenic Activity in a First Phase I/IIa Glioblastoma Trial," Mol. Ther. 25(12):2620-2634 (2017).
Ginting et al., "Proinflammatory response induced by Newcastle disease virus in tumor and normal cells," Oncolytic Virotherapy 6:21-30 (2017).
Girgis et al., "Cell surface expression of the vaccinia virus complement control protein is mediated by interaction with the viral A56 protein and protects infected cells from complement attack," J. Virol. 82(9):4205-4214 (2008).
Gong et al., "Clinical development of reovirus for cancer therapy: An oncolytic virus with immune-mediated antitumor activity," World J. Methodol. 6(1):25-42 (2016).
Guo et al., "Neoantigen Vaccine Delivery for Personalized Anticancer Immunotherapy," Front. Immunol. 9:1499 (2018), 8 pages.
Guo et al., "The combination of immunosuppression and carrier cells significantly enhances the efficacy of oncolytic poxvirus in the pre-immunized host," Gene Ther. 17(12):1465-1475 (2010).
Guo et al., "Oncolytic virotherapy: molecular targets in tumor-selective replication and carrier cell-mediated delivery of oncolytic viruses," Biochim. Biophys. Acta 1785(2):217-231 (2008).
Henderson, D.A. and B. Moss, "Recombinant Vaccinia Virus Vaccines," in Plotkin SA, Orenstein WA, cditors. Vaccincs. 3rd Edition. Philadephia: Saunders (1999), 3 pages.
Heo et al., "Sequential therapy with JX-594, a targeted oncolytic poxvirus, followed by sorafenib in hepatocellular carcinoma: preclinical and clinical demonstration of combination efficacy," Mol. Ther. 19(6):1170-1179 (2011).
Hou et al., "Oncolytic Virus-Mediated Targeting of PGE2 in the Tumor Alters the Immune Status and Sensitizes Established and Resistant Tumors to Immunotherapy," Cancer Cell 30:108-119 (2016).
Huang, T., "Vaccinia Virus-mediated Therapy of Solid Tumor Xenografts: Intra-tumoral Delivery of Therapeutic Antibodies," Dissertation (2013), 172 pages.
Huang et al., "The use of hypoxic cultured mesenchymal stem cell for oncolytic virus therapy," Cancer Gene Therapy 20: 308-316 (2013).
Huang et al., "Vascular normalization as an emerging strategy to enhance cancer immunotherapy," Cancer Res. 73(10):2943-2948 (2013).
Huehls et al., "Bispecific T-cell engagers for cancer immunotherapy," Immunol. Cell Biol. 93(3):290-296 (2015).
Hutzen et al., "Advances in the design and development of oncolytic measles viruses," Oncolytic Virotherapy 4:109-118 (2015).
Ilett et al., "Internalization of oncolytic reovirus by human dendritic cell carriers protects the virus from neutralization," Clin. Cancer Res. 17(9):2767-2776 (2011).
Ilett et al., "Dendritic cells and T cells deliver oncolytic reovirus for tumour killing despite pre-existing anti-viral immunity," Gene Ther. 16(5):689-699 (2009).
IUPAC-IUB Commission on Biochemical Nomenclature, "Symbols for Amino-Acid Derivatives and Peptides Recommendations (1971)," Biochemistry 11:1726-1732 (1972).
Jarahian et al., "Modulation of NKp30- and NKp46-mediated natural killer cell responses by poxviral hemagglutinin," PLoS Pathogens 7(8):e1002195 (2011), 18 pages.
Jennings et al., "Lymphokine-activated killer and dendritic cell carriage enhances oncolytic reovirus therapy for ovarian cancer by overcoming antibody neutralization in ascites," Int. J. Cancer 134:1091-1101 (2014).
Jiang et al., "Oncolytic adenovirus research evolution: from cell-cycle checkpoints to immune checkpoints," Curr. Opin. Virol. 13:33-39 (2015).
John et al., "Oncolytic Virus and Anti-4-1BB Combination Therapy Elicits Strong Antitumor Immunity against Established Cancer," Cancer Research 72(7): 1651-1660 (2012).
Josiah et al., "Adipose-derived Stem Cells as Therapeutic Delivery Vehicles of an Oncolytic Virus for Glioblastoma," Mol. Ther. 18(2): 377-85 (2010).
Josephs et al., "Unleashing endogenous TNF-alpha as a cancer immunotherapeutic," J. Transl. Med. 16:242 (2018), 8 pages.
Kaufman et al., "Oncolytic viruses: a new class of immunotherapy drugs," Nat. Rev. Drug. Discov. 14(9):642-62 (2015).
Kazimirsky et al., "Mesenchymal stem cells enhance the oncolytic effect of Newcastle disease virus in glioma cells and glioma stem cells via the secretion of TRAIL," Stem Cell Research & Therapy 7:149 (2016), 10 pages.
Kelly, E.J. and S. J. Russell, "MicroRNAs and the regulation of vector tropism," Mol. Ther. 17(3):409-416 (2009).
Kelly et al., "Novel oncolytic agent GLV-1h68 is effective against malignant pleural mesothelioma," Hum. Gene Ther. 19:774-782 (2008).
Kemp et al., "Exploring Reovirus Plasticity for Improving Its Use as Oncolytic Virus," Viruses 8(1):4 (2016), 16 pages.
Kerrigan et al., "Mesenchymal stem cells for the delivery of oncolytic viruses in gliomas," Cytotherapy 19(4):445-457 (2017).
Kilinc et al., "Colonization of xenograft tumors by oncolytic vaccinia virus (VACV) results in enhanced tumor killing due to the involvement of myeloid cells," J. Transl. Med. 14(1):340 (2016), 12 pages.
Kilinc et al., "The ratio of ADSCs to HSC-progenitors in adipose tissue derived SVF may provide the key to predict the outcome of stem-cell therapy," Clin. Transl. Med. 7:5 (2018), 20 pages.
Kim et al., "Stem Cell-Based Cell Carrier for Targeted Oncolytic Virotherapy: Translational Opportunity and Open Questions," Viruses 7(12):6200-6217 (2015).
Kim et al., "Overview analysis of adjuvant therapies for melanoma—a special reference to results from vaccinia melanoma oncolysate adjuvant therapy trials," Surgical Oncol. 10:53-59 (2001).
Kimpel et al., "The Oncolytic Virus VSV-GP Is Effective against Malignant Melanoma," Viruses 10:108 (2018), 16 pages.
Kleinstiver et al., "High-fidelity CRISPR-Cas9 nucleases with no detectable genome-wide off-target effects," Nature 529(7587):490-495 (2016).
Koch et al., "Pluripotent stem cells escape from senescence-associated DNA methylation changes," Genome Res. 23:248-259 (2013).
Kohler, G. and C. Milstein, "Continuous cultures of fused cells secreting antibody of predefined specificity," Nature 256:495-97 (1975).

(56) References Cited

OTHER PUBLICATIONS

Kohler et al., "Derivation of specific antibody-producing tissue culture and tumor lines by cell fusion," Eur. J. Immunol. 6:511-519 (1976).
Kohlhapp, F.J. and H.L. Kaufman, "Molecular Pathways: Mechanism of Action for Talimogene Laherparepvec, a New Oncolytic Virus Immunotherapy," Clin. Cancer Res. 22(5):1048-1054 (2016).
Komarova, S. et al., "Mesenchymal progenitor cells as cellular vehicles for delivery of oncolytic adenoviruses," Mol. Cancer Ther. 5(3):755-66 (2006).
Kong et al., "A Review of Anti-Angiogenic Targets for Monoclonal Antibody Cancer Therapy," Int. J. Mol. Sci. 18:1786 (2017), 25 pages.
Koprivnikar et al., "Safety, efficacy, and clinical utility of asparaginase in the treatment of adult patients with acute lymphoblastic leukemia," OncoTargets and Therapy 10:1413-1422 (2017).
Kozlova et al., "Inactivation and mineralization of aerosol deposited model pathogenic microorganisms over TiO2 and Pt/TiO2," Environ. Sci. Technol. 44:5121-5126 (2010).
Kuhn et al., "Cre/loxP recombination system and gene targeting," In: Clarke, A.R. (eds) Transgenesis Techniques. Methods in Molecular Biology, vol. 180. Springer, Totowa, NJ. (2002), pp. 175-204.
Kutinova et al., "Search for optimal parent for recombinant vaccinia virus vaccines. Study of three vaccinia virus vaccinal strains and several virus lines derived from them," Vaccine 13(5):487-493 (1995).
Lam et al., "Safety and clinical usage of newcastle disease virus in cancer therapy," J. Biomed. Biotechnol. 2011:718710 (2011), 13 pages.
Lanitis et al, "Targeting the tumor vasculature to enhance T cell activity," Curr. Opin. Immunol. 33:55-63 (2015).
Laurie et al., "A phase 1 clinical study of intravenous administration of PV701, an oncolytic virus, using two-step desensitization," Clin. Cancer Res. 12(8):2555-2562 (2006).
Lee, S. and Margolin, K., "Cytokines in cancer immunotherapy," Cancers 3:3856-3893 (2011).
Li et al., "Coadministration of a Herpes Simplex Virus-2-Based Oncolytic Virus and Cyclophosphamide Produces a Synergistic Antitumor Effect and Enhances Tumor-Specific Immune Responses," Cancer Res. 67(16):7850-7855 (2007).
Lin et al., "Ovarian cancer-related hypophosphatemic osteomalacia—a case report," J. Clin. Endocrinol. Metab. 99(12):4403-7 (2014).
Lin et al., "Treatment of anaplastic thyroid carcinoma in vitro with a mutant vaccinia virus," Surgery 142(6):976-983 (2007).
Liu et al., "The targeted oncolytic poxvirus JX-594 demonstrates antitumoral, antivascular, and anti-HBV activities in patients with hepatocellular carcinoma," Mol. Ther. 16:1637-1642 (2008).
Lu et al., "Genetic engineering of dendritic cells to express immunosuppressive molecules (viral IL-10, TGF-beta, and CTLA4Ig)," J. Leukoc. Biol. 66(2):293-296 (1999).
Machine-generated English translation of WO 2011/070974, 14 pages.
Mader et al., "Mesenchymal stem cell carriers protect oncolytic measles viruses from antibody neutralization in an orthotopic ovarian cancer therapy model," Clin. Cancer Res. 15(23):7246-7255 (2009).
Mali et al, "Cas9 as a versatile tool for engineering biology," Nat Methods 10(10): 957-63 (2013).
Marin-Acevedo et al., "Next generation of immune checkpoint therapy in cancer: new developments and challenges," Journal of Hematology & Oncology 11:39 (2018), 20 pages.
Martinez-Quintanilla et al., "Encapsulated stem cells loaded with hyaluronidase-expressing oncolytic virus for brain tumor therapy," Mol. Ther. 23(1):108-118 (2015).
Matuszewska et al., "Combining Vascular Normalization with an Oncolytic Virus Enhances Immunotherapy in a Preclinical Model of Advanced-Stage Ovarian Cancer," Clin. Cancer Res 25(5):1624-1638 (2019), 32 pages.
Matveeva et al., "Oncolysis by paramyxoviruses: preclinical and clinical studies," Molecular Therapy—Oncolytics 2, 150017 (2015), 14 pages.
McCart et al., "Systemic cancer therapy with a tumor-selective vaccinia virus mutant lacking thymidine kinase and vaccinia growth factor genes," Cancer Res. 61:8751-8757 (2001).
Meyers et al., "Current Immunotherapeutic Strategies to Enhance Oncolytic Virotherapy," Front. Oncol. 7:114 (2017), 9 pages.
Miao et al., "Prostaglandin E2 and PD-1 mediated inhibition of antitumor CTL responses in the human tumor microenvironment," Oncotarget 8(52):89802-89810 (2017).
Miles et al., "Anthrax toxin receptor 1 is the cellular receptor for Seneca Valley virus," J. Clin. Invest. 127(8):2957-2967 (2017).
Minev et al., "First-in-human study of TK-positive oncolytic vaccinia virus delivered by adipose stromal vascular fraction cells," Transl. Med. 17 (1):271 (2019), 15 pages.
Monath et al., "ACAM2000 clonal Vero cell culture vaccinia virus (New York City Board of Health strain)—a second-generation smallpox vaccine for biological defense," Int. J. of Infect. Dis. 8 Suppl 2:S31-44 (2004).
Moreno et al., "Human Menstrual Blood-Derived Mesenchymal Stem Cells as Potential Cell Carriers for Oncolytic Adenovirus," Stem Cells International 2017:3615729 (2017), 10 pages.
Moehler et al., "Oncolytic virotherapy as emerging immunotherapeutic modality: potential of parvovirus H-1," Frontiers in Oncology 4:92 (2014), 10 pages.
Moss, B., "Poxvirus vectors: cytoplasmic expression of transferred genes," Curr. Opin. Genet. Dev. 3:86-90 (1993).
Msaouel et al., "Oncolytic measles virus strains as novel anticancer agents," Expert Opin. Biol. Ther. 13(4):483-502 (2013).
Munguia et al., "Cell carriers to deliver oncolytic viruses to sites of myeloma tumor growth," Gene Ther 15(10): 797-806 (2008).
Muik et al., "Re-engineering vesicular stomatitis virus to abrogate neurotoxicity, circumvent humoral immunity, and enhance oncolytic potency," Cancer Res. 74(13):3567-3578 (2014).
Mukherjee et al., "Non-invasive imaging using reporter genes altering cellular water permeability," Nature Communications 7:13891 (2016), 9 pages.
Naik, S. and S. J. Russell, "Engineering oncolytic viruses to exploit tumor specific defects in innate immune signaling pathways," Expert Opin. Biol. Ther. 9(9):1163-1176 (2009).
Nakashima et al., "Directing systemic oncolytic viral delivery to tumors via carrier cells." Cytokine Growth Factor Reviews 21(2-3): 119-126 (2010).
Neves, H. and H.F. Kwok, "Recent advances in the field of anti-cancer immunotherapy," BBA Clinical 3:280-288 (2015).
Nguyen et al., "Vaccinia virus-mediated expression of human erythropoietin in tumors enhances virotherapy and alleviates cancer-related anemia in mice," Mol. Ther. 21(11):2054-62 (2013).
Nichols et al., "Poxviruses Utilize Multiple Strategies to Inhibit Apoptosis," Viruses 9:215 (2017), 35 pages.
Nishio et al., "Armed oncolytic virus enhances immune functions of chimeric antigen receptor-modified T cells in solid tumors," Cancer Res. 74(18):5195-5205 (2014).
Oberstein et al., "Site-specific transgenesis by Cre-mediated recombination in *Drosophila*," Nat. Methods 2(8):583-5 (2005).
O'Hare et al., "Conditional immortalization of freshly isolated human mammary fibroblasts and endothelial cells," Proc. Natl Acad. Sci. USA 98(2):646-651 (2001).
Pardoll, D. M. "The blockade of immune checkpoints in cancer immunotherapy," Nat. Rev. Cancer 12(4):252-264 (2012).
Park et al., "Use of a targeted oncolytic poxvirus, JX-594, in patients with refractory primary or metastatic liver cancer: a phase I trial," Lancet Oncol. 9:533-542 (2008).
Payne et al., "Human adipose-derived mesenchymal stem cells engineered to secrete IL-10 inhibit APC function and limit CNS autoimmunity," Brain, Behavior, and Immunity 30(1):103-114 (2013).
Peggs et al., "Cancer immunotherapy: co-stimulatory agonists and co-inhibitory antagonists," Clinical and Experimental Immunology 157:9-19 (2009).

(56) References Cited

OTHER PUBLICATIONS

Petrov et al., "Canine Adipose-Derived Mesenchymal Stem Cells (cAdMSCs) as a "Trojan Horse" in Vaccinia Virus Mediated Oncolytic Therapy against Canine Soft Tissue Sarcomas," Viruses 12(7):750 (2020), 13 pages.
Phan et al., "Cancer regression and autoimmunity induced by cytotoxic T lymphocyte-associated antigen 4 blockade in patients with metastatic melanoma," Proc. Natl. Acad. Sci. U.S.A. 100:8372-8377 (2003).
Pol et al., "Development and applications of oncolytic Maraba virus vaccines," Oncolytic Virother. 7:117-128 (2018).
Portulano et al., "The Na+/l-symporter (NIS): mechanism and medical impact," Endocr. Rev. 35(1):106-149 (2014).
Power, A.T. and J.C. Bell, "Cell-based Delivery of Oncolytic Viruses: A New Strategic Alliance for a Biological Strike Against Cancer," Mol. Ther. 15(4):660-665 (2007).
Power et al., "Carrier cell-based delivery of an oncolytic virus circumvents antiviral immunity," Molecular Therapy 15(1):123-130 (2007).
Rajabi, M. and S. A. Mousa, "The Role of Angiogenesis in Cancer Treatment," Biomedicines 5(2):34 (2017), 12 pages.
Ramirez et al., "Patient-derived mesenchymal stem cells as delivery vehicles for oncolytic virotherapy: novel state-of-the-art technology," Oncolytic Virotherapy 4:149-155 (2015).
Ran et al., "Double nicking by RNA-guided CRISPR Cas9 for enhanced genome editing specificity," Cell 154(6):1380-9 (2013).
Ravcra ct al., "The Sodium/Iodide Symporter (NIS): Molecular Physiology and Preclinical and Clinical Applications," Annu Rev Physiol. 79:261-289 (2017).
Raykov et al., "Carrier cell-mediated delivery of oncolytic parvoviruses for targeting metastases," Int. J. Cancer 109:742-749 (2004).
Response, filed Aug. 17, 2009, to Third Party Submission of Protest Documents Submitted Under 37 CFR § 1.99 on Aug. 5, 2009 in connection with U.S. Appl. No. 12/218,953, 5 pages.
Rincon et al., "Mesenchymal Stem Cell Carriers Enhance Antitumor Efficacy of Oncolytic Adenoviruses in an Immunocompetent Mouse Model," Oncotarget 8(28):45415-45431 (2017).
Rogers et al., "Rationale for the clinical use of adipose-derived mesenchymal stem cells for COVID-19 patients," J. Transl. Med. 18(1):203 (2020), 19 pages.
Rosengard et al., "Functional characterization of soluble and membrane-bound forms of vaccinia virus complement control protein (VCP)," Mol. Immunol. 36(10):685-697 (1999).
Roy, D. G. and J. C. Bell, "Cell carriers for oncolytic viruses: current challenges and future directions," Oncolytic Virother. 2:47-56 (2013).
Qiao et al., "Loading of oncolytic vesicular stomatitis virus onto antigen-specific T cells enhances the efficacy of adoptive T-cell therapy of tumors," Gene Ther. 15(8):604-616 (2008).
Qian et al., "Seneca Valley Virus Suppresses Host Type I Interferon Production by Targeting Adaptor Proteins MAVS, TRIF, and TANK for Cleavage," J. Virol. 91(16):e00823-17 (2017), 17 pages.
Schaefer et al., "Unexpected mutations after CRISPR-Cas9 editing in vivo," Nat. Methods 14(6): 547-548 (2017).
Shaw, A.R. and M. Suzuki, "Recent advances in oncolytic adenovirus therapies for cancer," Curr. Opin. Virol. 21:9-15 (2016).
Shchelkunov et al., "The gene encoding the late nonstructural 36K protein of vaccinia virus is essential for virus reproduction," Virus Research 28:273-283 (1993).
Sheikhi et al., "Whole Tumor Cell Vaccine Adjuvants: Comparing IL-12 to IL-2 and IL-15," Iran J. Immunol. 13(3):148-166 (2016).
Shulman et al., "A better cell line for making hybridomas secreting specific antibodies," Nature 276:269-270 (1978).
Smith et al., "Vaccinia virus immune evasion: mechanisms, virulence and immunogenicity," Journal of General Virology 94:2367-2392 (2013).
Sokolowski et al., "Oncolytic virotherapy using herpes simplex virus: how far have we come?" Oncolytic Virotherapy 4:207-219 (2015).
Sroller et al., "Effect of 3-beta-hydroxysteroid dehydrogenase gene deletion on virulence and immunogenicity of different vaccinia viruses and their recombinants," Archives Virology 143:1311-1320 (1998).
Storcy et al., "Conditional immortalization of primary cells by human papillomavirus typc 18 E6 and EJ-ras defines an E6 activity in G0/G1 phase which can be substituted for mutations in p53," Oncogene 11:653-661 (1995) [abstract], 2 pages.
Studeny et al., "Mesenchymal Stem Cells: Potential Precursors for Tumor Stroma and Targeted-Delivery Vehicles for Anticancer Agents," J. Natl. Cancer Inst. 96(21):1593-1603 (2004).
Sumner et al., "Increased attenuation but decreased immunogenicity by deletion of multiple vaccinia virus immunomodulators," Vaccine 34:4827-4834 (2016).
Tayeb et al., "Therapeutic potential of oncolytic Newcastle disease virus: a critical review," Oncolytic Virotherapy 4:49-62 (2015).
Thorne et al., "Vaccinia virus and oncolytic virotherapy of cancer," Curr. Opin. Mol. Ther. 7(4):359-365 (2005).
Thorne et al., "Targeting localized immune suppression within the tumor through repeat cycles of immune cell-oncolytic virus combination therapy," Molecular Therapy 18(9):1698-1705 (2010).
Timiryasova et al., "Construction of Recombinant Vaccinia Viruses Using PUV-Inactivated Virus as a Helper," Biotechniques 31(3):534-540 (2001).
Tong et al., "Evidence for differential viral oncolytic efficacy in an in vitro model of epithelial ovarian cancer metastasis," Mol. Ther. Oncolytics 2(23):15013 (2015), 10 pages.
Traktman, P., Chapter 27, "Poxvirus DNA Replication," pp. 775-798, in DNA Replication in Eukaryotic Cells, Cold Spring Harbor Laboratory Press (1996).
Tsoneva et al., "Humanized Mice with Subcutaneous Human Solid Tumors for Immune Response Analysis of Vaccinia Virus-Mediated Oncolysis," Mol. Ther. Oncolytics 5:41-61 (2017).
Uusi-Kerttula et al., "Oncolytic Adenovirus: Strategies and Insights for Vector Design and Immuno-Oncolytic Applications," Viruses 7:6009-6042 (2015).
Volk et al., "Monoclonal antibodies to the glycoprotein of vesicular stomatitis virus: comparative neutralizing activity," J. Virol. 42(1):220-227 (1982).
Wall et al., "Recent advances in conditional cell immortalization technology," Cell Gene Therapy Insights 2(3):339-355 (2016).
Wang et al., "Oncolytic vaccinia virus GLV-1h68 strain shows enhanced replication in human breast cancer stem-like cells in comparison to breast cancer cells," J. Transl. Med. 10:167 (2012), 15 pages.
Wang et al., "Optical detection and virotherapy of live metastatic tumor cells in body fluids with vaccinia strains," PLoS One 8(9):e71105 (2013), 12 pages.
Waterman et al., "A New Mesenchymal Stem Cell (MSC) Paradigm: Polarization into a Pro-Inflammatory MSC1 or an Immunosuppressive MSC2 Phenotype," PLoS One 5(4):e10088 (2010), 14 pages.
Willmon et al., "Cell carriers for oncolytic viruses: Fed Ex for cancer therapy," Molecular Therapy 17(10):1667-1676 (2009).
Yakubitskiy et al., "Attenuation of Vaccinia Virus," Acta Naturae 7(4):113-121 (2015).
Yamamoto et al., "Recent advances in genetic modification of adenovirus vectors for cancer treatment," Cancer Sci. 108:831-837 (2017).
Yang et al., "Adult neural stem cells expressing IL-10 confer potent immunomodulation and remyelination in experimental autoimmune encephalitis," J. Clin. Invest. 119(12):3678-3691 (2009).
Yang et al., "Targeting VEGF/VEGFR to Modulate Antitumor Immunity, " Front. Immunol. 9:978 (2018), 9 pages.
Yin et al., "Modulation of the Intratumoral Immune Landscape by Oncolytic Herpes Simplex Virus Virotherapy," Front. Oncol. 7:136 (2017), 7 pages.
Yla-Pelto et al., "Therapeutic Use of Native and Recombinant Enteroviruses," Viruses 8(3):57 (2016), 15 pages.
Yokoda et al., "Oncolytic Adenoviruses in Gastrointestinal Cancers," Biomedicines 6:33 (2018), 13 pages.

(56) References Cited

OTHER PUBLICATIONS

Yokouchi et al., "Anti-OX40 monoclonal antibody therapy in combination with radiotherapy results in therapeutic antitumor immunity to murine lung cancer," Cancer Sci. 99(2):361-367 (2008).
Yu et al., "Oncolytic vaccinia therapy of squamous cell carcinoma," Mol. Cancer 8:45 (2009), 9 pages.
Yu et al., "Regression of human pancreatic tumor xenografts in mice after a single systemic injection of recombinant vaccinia virus GLV-1h68," Mol. Cancer Ther. 8(1):141-151 (2009).
Yu et al., "Visualization of tumors and metastases in live animals with bacteria and vaccinia virus encoding light-emitting proteins," Nat. Biotech. 22(3):313-320 (2004).
Yu, Y.A. and A.A. Szalay, "A Renilla luciferase-Aequorea GFP (ruc-gfp) fusion gene construct permits real-time detection of promoter activation by exogenously administered mifepristone in vivo," Mol. Genet. Genomics 268:169-178 (2002).
Yuan et al., "A Simple and Efficient Approach to Construct Mutant Vaccinia Virus Vectors," J. Vis. Exp. 116:e54171 (2016), 7 pages.
Yuan et al., "Interleukin-23-Expressing Bone Marrow-Derived Neural Stem-Like Cells Exhibit Antitumor Activity Against Intracranial Glioma," Cancer Rescarch 66(5):2630-2638 (2006).
Zch et al., "First-in-man study of western reserve strain oncolytic vaccinia virus: safety, systemic spread, and antitumor activity," Mol. Ther. 23(1):202-214 (2015).
Zhang et al., "Eradication of solid human breast tumors in nude mice with an intravenously injected light-emitting oncolytic vaccinia virus," Cancer Research 67(20):10038-10046 (2007).
Zhao et al., "Strategic Combinations: The Future of Oncolytic Virotherapy with Reovirus," Mol. Cancer Ther. 15(5):767-773 (2016).
Zinoviev et al., "Identification of the gene encoding vaccinia virus immunodominant protein p35," Gene 147:209-214 (1994).
Draganov et al., "Evaluation of the potential of oncolytic vaccinia virus delivered by autologous SVF to modulate innate and adaptive immunity in patients with diverse solid and hematological malignancies," Abstract No. 4473 presented at AACR meeting Jun. 22, 2020. Virtual Meeting, 2 pages.
Minev et al., "First in man study of TK positive oncolytic vaccinia virus delivered by adipose stromal vascular fraction cells," [abstract] Journal for Immuno Therapy of Cancer, 6(Suppl 1):115, Abstract No. P609, Nov. 2018, 2 pages.
Minev et al., "First in man study of TK positive oncolytic vaccinia virus delivered by adipose stromal vascular fraction cells," poster presented at The Society for Immunotherapy of Cancer's (SITC) 33rd Annual Meeting | Nov. 7-11, 2018 Washington, D.C., 1 page.
Nguyen et al., "A cell-based platform to potentiate oncolytic virus therapies," poster presented at ASCO-SITC Clinical Immuno-Oncology Symposium Feb. 6-8, 2020 Orlando, Florida, 1 page.
Nguyen et al., "A cell-based platform to potentiate oncolytic virus: Potential approach for cancer therapies," abstract presented at ASCO-SITC Clinical Immuno-Oncology Symposium Feb. 6, 2020 Orlando, Florida, Abstract No. 21, 2 pages.
Nguyen et al., "CAL1 vaccinia virus as oncolytic agent and potential use of cell-based platform to enhance its therapeutic effects," Abstract No. 6542 presented at AACR meeting Jun. 22, 2020. Virtual Meeting, 2 pages.
Santidrian et al., "A cell-based platform to protect and enhance oncolytic virus therapies," [abstract] Journal for ImmunoTherapy of Cancer, 6(Suppl 1):115, Abstract No. P617, Nov. 2018, 1 pagd.
Santidrian et al., "A cell-based platform to potentiate oncolytic virus therapies," poster presented at The Society for Immunotherapy of Cancer's (SITC) 33rd Annual Meeting | Nov. 7-11, 2018 Washington, D.C., 1 page.
News Release, Calidi Biotherapeutics "Calidi Biotherapeutics Announces Two Abstracts Accepted for Presentation at the Society for Immunotherapy of Cancer's (SITC) 33rd Annual Meeting." Published Nov. 6, 2018 [online] Retrieved from: <URL: calidibio.com/2018/11/06/calidi-biotherapeutics-inc-granted-new-patent-from-USPTO-for-cell-based-delivery-of-oncolytic-vaccinia-viruses-2/ [retrieved on Nov. 29, 2018], 3 pages.
News Release, "Calidi Biotherapeutics Announces A Collaborative Study With The National Institutes Of Health (NIH) On The Therapeutic Potential Of Oncolytic Viruses Delivered By Mesenchymal Stem Cells," Published May 28, 2019 [online] Retrieved from: <URL: prnewswire.com/news-releases/calidi-biotherapeutics-announces-a-collaborative-study-with-the-national-institutes-of-health-nih-on-the-therapeutic-potential-of-oncolytic-viruses-delivered-by-mesenchymal-stem-cells-300857135.html [retrieved on May 28, 2019], 3 pages.
News Release, "Calidi Biotherapeutics Presents Data at the 2020 ASCO-SITC Clinical Immuno-Oncology Symposium," Published Feb. 13, 2020 [online] Retrieved from: <URL: calidibio.com/2020/02/13/calidi-biotherapeutics-presents-data-at-the-2020-asco-sitc-clinical-immuno-oncology-symposium/ [retrieved on Mar. 11, 2020], 4 pages.
News Release, "Calidi Biotherapeutics Announces Two Abstracts Accepted for Presentation at AACR 2020 Virtual Annual Meeting II," Published Jun. 22, 2020 [online] retrieved from: <URL: businesswire.com/news/home/20200622005121/en/Calidi-Biotherapeutics-Announces-Abstracts-Accepted-Presentation-AACR [retrieved on Jun. 23, 2020], 2 pages.
News Release, entitled "Calidi Biotherapeutics Announces Partnership with GenScript ProBio for Distribution of its SuperNova-1 Technology." Published Jun. 8, 2021 [online]; retrieved on Jun. 16, 2021, from: <URL:businesswire.com/news/home/20210608005504/en/Calidi-Biotherapeutics-Announces-Partnership-with-GenScript-ProBio-for-Distribution-of-its-SuperNova-1-Technology, 2 pages.
International Search Report and Written Opinion, issued Apr. 7, 2020, in connection with International Patent Application No. PCT/US2019/060160, 20 pages.
Demand for International Preliminary Exam, filed Sep. 7, 2020, to International Search Report and Written Opinion, issued Apr. 7, 2020, in connection with International Patent Application No. PCT/US2019/060160, 78 pages.
Written Opinion of the International Preliminary Examining Authority, issued Oct. 12, 2020, in connection with International Patent Application No. PCT/US2019/060160, 7 pages.
Response, filed Dec. 14, 2020, to Written Opinion of the International Preliminary Examining Authority, issued Oct. 12, 2020, in connection with International Patent Application No. PCT/US2019/060160, 56 pages.
International Preliminary Report on Patentability (Chapter II of the PCT), mailed Jan. 26, 2021, in connection with International Application No. PCT/US2019/060160, 11 pages.
Examiner's Report, issued Apr. 25, 2022, in connection with Canadian Patent Application No. 3116192, 6 pages.
Response, filed Aug. 25, 2022, to Examiner's Report, issued Apr. 25, 2022, in connection with Canadian Patent Application No. 3116192, 48 pages.
Examiner's Report, issued Dec. 14, 2022, in connection with Canadian Patent Application No. 3116192, 5 pages.
Response, filed Apr. 14, 2023, to Examiner's Report, issued Dec. 14, 2022, in connection with Canadian Patent Application No. 3116192, 41 pages.
Office Action, issued Nov. 8, 2022, in connection with Japanese Patent Application No. 2021-523930 [English language translation and original Office Action as issued in Japanese], 8 pages.
Response, filed May 1, 2023, to Office Action, issued Nov. 8, 1011, in connection with Japanese Patent Application No. 2021-523930 [English instructions for Response, amended claims as filed in English, and original documents as filed in Japanese], 39 pages.
Office Action, issued Aug. 18, 2022, in connection with U.S. Appl. No. 16/676,413, 22 pages.
Response, filed Aug. 22, 2022, to Office Action, issued Aug. 18, 2022, in connection with U.S. Appl. No. 16/676,413, 9 pages.
Office Action, issued Sep. 30, 2022, in connection with U.S. Appl. No. 16/676,413, 7 pages.
Amendment and Request for Continued Examination, filed Dec. 2, 2022, responsive to Office Action, issued Sep. 30, 2022, in connection with U.S. Appl. No. 16/676,413, 15 pages.
Notice of Allowance, mailed Jan. 10, 2023, in connection with U.S. Appl. No. 16/676,413, 7 pages.

(56) References Cited

OTHER PUBLICATIONS

Letter/Written Disclosure of the Supplemental Information Disclosure Statement for the above-referenced application, filed herewith on May 1, 2026, 2 pages.
Notice of Allowance, issued Feb. 6, 2025, in connection with Canadian Patent Application No. 3,116,192, 1 page.
Response, filed Feb. 17, 2025, to Office Action, issued Nov. 28, 2023, in connection with Eurasian Patent Application No. 202100155 [English instructions for response; Response as filed in Russian; and Russian language of claims as filed], 56 pages.
Notice of Allowance, issued Apr. 22, 2025, in connection with Eurasian Patent Application No. 202100155 [English translation and original documents as issued in Russian], 11 pages.
Response, filed Mar. 31, 2025, to Office Action, issued Oct. 1, 2024, in connection with Japanese Patent Application No. 2023-128476 [English language instructions, English translation of claims as filed, and Response as filed in Japanese], 37 pages.
Office Action, issued Jul. 1, 2025, in connection with Japanese Patent Application No. 2023-128476 [English language translation and original Office Action as issued in Japanese], 13 pages.
Response, filed Dec. 26, 2025, to Office Action, issued Jul. 1, 2025, in connection with Japanese Patent Application No. 2023-128476 [English language instructions, English translation of claims as filed, and Response as filed in Japanese], 39 pages.
Notice of Allowance, issued Mar. 3, 2026, in connection with Japanese Patent Application No. 2023-128476 [Machine-generated English translation and Decision to Grant as issued in Japanese], 8 pages.
Response, filed Dec. 31, 2024, to Office Action, issued Oct. 31, 2024, in connection with Korean Patent Application No. 10-2021-7017256 [English language instructions and Response as filed in Korean], 77 pages.
Office Action, issued Jul. 28, 2025, in connection with Korean Patent Application No. 10-2021-7017256 [English language translation and original Office Action as issued in Korean], 10 pages.
Response, filed Jan. 28, 2026, Office Action, issued Jul. 28, 2025, in connection with Korean Patent Application No. 10-2021-7017256 [English language instructions, English language translation of claims as filed, and Response as filed in Korean], 84 pages.
Letter/Written Disclosure of the Supplemental Information Disclosure Statement for the above- referenced application, filed herewith on Aug. 14, 2026, 3 pages.
Examiner's Report, issued Jul. 15, 2026, in connection with Australian Patent Application No. 2024216517, 7 pages.
Damaso et al., "Protein synthesis in vaccinia virus-infected cells: I. Effect of hypertonic shock recovery," Archives of Virology 123(3):295-308 (1992).
Jevremovic et al., "Use of blood outgrowth endothelial cells as virus-producing vectors for gene delivery to tumors," American Journal of Physiology-Heart and Circulatory Physiology 287(2):H494-500 (2004).
Leoni et al., "Systemic delivery of HER2-retargeted oncolytic-HSV by mesenchymal stromal cells protects from lung and brain metastases," Oncotarget 6(33):34774-34787 (2015).
Muthana et al., "Use of macrophages to target therapeutic adenovirus to human prostate tumors," Cancer Research 71(5):1805-15 (2011).
Xu et al., "Carrier cells for delivery of oncolytic measles virus into tumors: determinants of efficient loading," Virologica Sinica 33(3):234-40 (2018).

ENHANCED SYSTEMS FOR CELL-MEDIATED ONCOLYTIC VIRAL THERAPY

RELATED APPLICATIONS

This application is a continuation of allowed U.S. application Ser. No. 16/676,413 entitled "ENHANCED SYSTEMS FOR CELL-MEDIATED ONCOLYTIC VIRAL THERAPY," filed Nov. 6, 2019, to inventors Antonio Fernandez Santidrian, Duong Hoang Nguyen, and Dobrin Draganov, which claims the benefit of and priority to U.S. Provisional Application Ser. No. 62/789,458, entitled "ENHANCED SYSTEMS FOR CELL-MEDIATED ONCOLYTIC VIRAL THERAPY," filed Jan. 7, 2019, to inventors Antonio Fernandez Santidrian, Duong Hoang Nguyen, and Dobrin Draganov, and U.S. Provisional Application Ser. No. 62/756,550, entitled "ENHANCED SYSTEMS FOR CELL-MEDIATED ONCOLYTIC VIRAL THERAPY," filed Nov. 6, 2018, to inventor Antonio Fernandez Santidrian.

This application is related to International Patent Application No. PCT/US2019/060160, entitled "ENHANCED SYSTEMS FOR CELL-MEDIATED ONCOLYTIC VIRAL THERAPY," filed Nov. 6, 2019, to inventors Antonio Fernandez Santidrian, Duong Nguyen, Dobrin Draganov.

The subject matter and disclosure of each of these applications is incorporated by reference in their entirety.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Apr. 3, 2023, is 720 kilobytes in size, and is titled 2601BSEQ001.XML. A substitute Sequence Listing is filed electronically herewith, the contents of which are incorporated by reference in their entirety. The electronic file was created on May 10, 2023, is identical, 721 kilobytes in size, and titled 2601BSEQ003.xml.

FIELD OF THE INVENTION

Provided are cell-assisted viral expression systems for improving oncolytic viral therapy, uses of the systems, and methods of treating cancers by administering the systems to subjects in need of such treatment.

BACKGROUND

The ability of the delivered or administered viruses to infect a tumor and colonize and/or replicate within tumors can be impeded by circulating neutralizing antibodies, innate and adaptive immune mechanisms, and other clearing mechanisms directed against the viruses and/or the carrier cells. Cells have been used as carriers for delivery of oncolytic viruses for cancer therapy. There is a need for improved systems that potentiate the therapeutic efficacy of oncolytic viruses.

SUMMARY

It is shown herein that the use of cells, such as stem cells, for delivery of oncolytic viruses can be improved by incubating the cells and virus for a sufficient time for the viruses to express encoded genes and/or to replicate. Following incubation, the cells can be stored at reduced temperature for subsequent use. The extended incubation increases the effectiveness of oncolytic virus therapy compared to naked virus, and compared to prior uses of cells that had not been incubated with virus for a sufficient time. The resulting cells can be stored, such as cryopreserved or stored at reduced temperature, for subsequent use. The resulting cells, which provide a more effective oncolytic virus delivery vehicle, can be administered systemically as well as via other routes, including intratumoral, intraperitoneal and local administration.

Provided herein are cell-assisted viral expression systems (CAVES) that potentiate oncolytic viral therapy. The systems include: (1) a cell, such as a carrier cell, that is permissive to viral infection and replication; (2) an oncolytic virus; and (3) at least one expressed immunomodulatory or therapeutic gene encoded by the virus expressed in the cell. The CAVES are produced by incubating the cells and virus under conditions in which the virus infects the cell and the genes can be expressed. Exemplary cells potentiate oncolytic viral therapy having one or more characteristics for this purpose, such as, for example, the ability to: (a) amplify the virus and the expression of virus-encoded proteins; (b) protect the virus from inactivation by the humoral immune system or other serum component; and/or (c) facilitate colonization and/or spread of the viral infection within the tumor. The systems provided herein can be generated using any oncolytic virus and any cell that permits viral amplification and the expression of virus-encoded proteins. Generally, the cells/carrier cells are not tumor cells or inactivated tumor cells, but cells, such as, but not limited to, stem cells, and fibroblasts.

The systems provided herein can be generated by incubating together, ex vivo, a cell that is permissive to viral infection and replication and a virus, such as an oncolytic virus, for a predetermined period of time sufficient for viral infection and the expression of at least one virus-encoded immunomodulatory protein and/or at least one viral encoded and recombinantly expressed therapeutic protein, and, optionally, the expression of one or more cellular/recombinant cellular proteins.

To generate the CAVES, which does not employ the cells as standard delivery vehicles but, rather, uses the cells as part of a system that potentiates the delivered oncolytic viral therapy, generally requires incubation times of more than 2-4 hours, generally between about 5 or 6 hours and 72 or more hours, for example generally at least or between about 5 or 6 hours or between greater than about 5 or 6 hours to at least or between about 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 or more hours, for example between about 6 hours to 18 hours, or between about 12 hours to 48 hours. The time period, however, depends on the particular oncolytic virus and/or carrier cell, and combination thereof, used in the system. It is a time sufficient for infection of the cell with virus, and expression of a virally encoded immunomodulatory protein or encoded therapeutic protein. For example, in the vesicular stomatitis virus (VSV) viral replication cycle, the time to express a virus-encoded immunomodulatory protein and/or a recombinant protein, such as a therapeutic protein, generally is relatively short, on the order of 2-3 hours; for, vaccinia virus, the time to express a virus-encoded immunomodulatory protein and/or recombinant therapeutic protein generally is longer, on the order of 6-12 hours or more. For preparing a vaccinia virus CAVES, the virus generally should be incubated with the cells for at least about 6 hours.

Upon administration, the cell-assisted viral expression system (CAVES) provides an immediate supply of immunomodulatory and/or therapeutic proteins, regardless of tumor permissiveness to viral infection and/or amplification. Facilitating expression of viral-encoded immumodulatory and/or therapeutic genes results in a number of advantages. These include improved adaptation to allogeneic settings because the immunomodulators encoded by the virus are expressed prior to exposure to the cancer/tumor, so that they act immediately upon administration to block rejection of the virus and/or the cell by the patient's immune system. The cell-assisted viral expression systems (CAVESs) can facilitate the expression of proteins that block the inhibitory action of the complement.

While autologous cells can be used to produce the cell-assisted viral expression system (CAVES), the cell-assisted viral expression system (CAVES) provide a way to employ allogenic cells so that they can be manufactured and stored for administration in standard protocols. The cell-assisted viral expression systems (CAVESs) provided herein can be standardized for treating a patient population because viral amplification and the expression of one or more virus-encoded immunomodulatory proteins and/or recombinantly expressed therapeutic genes is initiated ex vivo for a predetermined amount of time prior to administration or prior to storage for future administration. Because the viruses infecting the cells are expressing encoded proteins when administered, the therapeutic effect of the systems provided herein is not subject to or less subject to variations caused by differences in the tumor microenvironments of the patients in the population. The cell-assisted viral expression systems (CAVESs) provided herein overcome or alleviate difficulties associated with non-permissive cancers/tumors, hostile microenvironments and/or low nutrient environments in tumors, which can be an impediment to viral amplification and viral-encoded gene expression. Release and spread of the virus in the tumor can occur immediately upon administration, due to the prior ex vivo initiation of viral amplification and the expression of viral-encoded immunomodulatory and/or therapeutic genes.

In any of the compositions and methods provided herein, the cells and/or viruses used to generate the CAVES and used in related methods are modified as provided herein. The modifications, as provided herein, can render improved therapeutic benefit, e.g., by incorporating encoded therapeutic products, or can help overcome immune and other barriers, such as tumor vascular shutdown, to improve therapeutic efficacy. In some embodiments, the cells are modified for conditional immortalization, i.e., they can stably be expanded to generate a large population by activating immortalization, then deactivated prior to administration to a subject so that uncontrolled cell division does not continue in the subject. For example, the cell ("carrier cell") can be modified to express one or more of wild type or modified (mutated or, e.g., as a fusion protein) c-myc, v-myc, E6/E7, hTERT, SV40 large tumor antigen, loxP and/or tetR to render the cell component of the CAVES amenable to conditional immortalization. Expansion of the carrier cell population so modified can be activated at a first time(s) prior to preparation of the CAVES and/or prior to administration of the CAVES to the subject, and expansion of the carrier cell population can inactivated at a second time subsequent to the expansion and prior to administration of the CAVES to the subject.

The systems provided herein can be stably and indefinitely stored under cryopreservation conditions, such as, for example, at −80° C., and can be thawed as needed or desired prior to administration. For example, the systems provided herein can be stored at a preserving temperature, such as −20° C. or −80° C., for at least or between about a few hours, 1, 2, 3, 4 or 5 hours, or days, including at least or between about a few years, such as, but not limited to, 1, 2, 3 or more years, for example for at least or about 1, 2, 3, 4 or 5 hours to at least or about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 hours or 4, 5, 6, 7, 8, 9, 10, 15, 20, 25 or 30 days or 1.5, 2, 2.5, 3, 3.5, 4, 4.5, 5, 5.5, 6, 6.5, 7, 7.5, 8, 8.5, 9, 9.5, 10, 10.5, 11, 11.5 or 12 months or 1, 2, 3, 4 or 5 or more years prior to thawing for administration. The systems provided herein also stably can be stored under refrigeration conditions such as, at 4° C. and/or transported on ice to the site of administration for treatment. For example, the systems provided herein can be stored at 4° C. or on ice for at least or between about a few hours, such as, but not limited to, 1, 2, 3, 4 or 5 hours, to at least or about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 or more hours prior to administration for treatment.

The cell-assisted viral expression systems (CAVESs) provided herein contain pre-expressed virus-encoded proteins, such as immunomodulators and/or recombinantly expressed therapeutic proteins, prior to administration for treatment of a subject. This permits the tumor microenvironment to respond to the treatment more quickly. The amount of virus used to generate the systems provided herein can be lesser than when the virus is administered directly, without ex vivo amplification. Because viral amplification and the expression of virus-encoded immunomodulators and/or recombinantly expressed therapeutic proteins has occurred ex vivo for a predetermined amount of time prior to being administered to the tumor site, allogeneic cells can be used to generate the systems provided herein because virus infection and release at the tumor site nonetheless can occur before the immune cells of the host initiate a response against the cells and/or virus. Because viral amplification and the expression of virus-encoded immunomodulators and/or recombinantly expressed therapeutic proteins has occurred ex vivo for a predetermined amount of time prior to being administered to the tumor site, extracellular enveloped virus particles (eeV), which can survive longer in circulation, can be manufactured in situ immediately following administration of the systems to the host.

Also provided herein are methods of treatment that include administering the systems provided herein to subjects in need of such treatment. The systems can be administered alone or in combination with, such as, for example, other immune oncology therapies including, but not limited to, checkpoint inhibitors, CAR-T cells, co-stimulatory molecules, therapeutic antibodies, bi-antibodies and antibody-drug conjugates.

DETAILED DESCRIPTION

Outline

A. Definitions

B. Selection of Components for Cell-Assisted Viral Expression Systems (CAVES)

1. Cells (i) Sensitized/Protected Cell Vehicles for Improved Viral Amplification and/or Immunomodulation (ii) Sensitized for Resistance to Virus-Mediated Killing (for extended survival and improved local immunosuppression)
(iii) Engineered Cell Vehicles for Improved Viral Amplification and/or Immunomodulation
(iv) Engineered Cell Vehicles to Express Angiogenesis Inhibitors for Vascular Normalization/Tumor Blood Vessels Reprogramming
(v) Engineered Cell Vehicles to Express Transgenes for Conditional Cell Immortalization
2. Viruses
C. Generation, Formulation, Storage and Transportation of CAVES
D. Pharmaceutical Compositions, Combinations and Kits
1. Pharmaceutical Compositions
2. Combinations
3. Kits
E. Combination (Additional) Therapies Administered with CAVES
F. Modes of Administration of CAVES for Therapy
a. Administration of Irradiated or Non-irradiated CAVES
b. Routes of Administration
c. Devices
d. Dosages of Administration Regimens
G. Treatment Methods and Monitoring Coordinated with Treatment
H. Exemplary Types of Cancers to be Treated
I. Examples A. Definitions Unless defined otherwise, all technical and scientific terms used herein have the same meaning as is commonly understood by one of skill in the art to which the invention(s) belong. All patents, patent applications, published applications and publications, GenBank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it is understood that such identifiers can change and particular information on the internet can come and go, but equivalent information can be found by searching the internet. Reference thereto evidences the availability and public dissemination of such information.

As used herein, a "virus" refers to any of group of infectious entities that cannot grow or replicate without a host cell. Viruses typically contain a protein coat and RNA or DNA as genetic material; they have no semipermeable membrane, and are capable of growth and multiplication only in living cells. Examples include influenza virus, mumps virus, poliovirus, Seneca Valley Virus, and semliki forest virus.

As used herein, "oncolytic viruses" refer to viruses that replicate selectively in tumor cells in tumorous subjects. These include viruses that naturally preferentially replicate and accumulate in tumor cells, such as poxviruses, and viruses that have been engineered to do so. Some oncolytic viruses can kill a tumor cell following infection of the tumor cell. For example, an oncolytic virus can cause death of the tumor cell by lysing the tumor cell or inducing cell death of the tumor cell. Exemplary oncolytic viruses include, but are not limited to, poxviruses, herpesviruses, adenoviruses, adeno-associated viruses, lentiviruses, retroviruses, rhabdoviruses, papillomaviruses, vesicular stomatitis virus, measles virus, Newcastle disease virus, picornavirus, Sindbis virus, papillomavirus, parvovirus, reovirus, and coxsackievirus.

As used herein, the term "therapeutic virus" refers to a virus that is administered for the treatment of a disease or disorder, such as a neoplastic disease, such as cancer, a tumor and/or a metastasis or inflammation or wound or diagnosis thereof and/or both. Generally, a therapeutic virus herein is one that exhibits anti-tumor activity and minimal toxicity.

As used herein the term "vaccinia virus" or "VACV" or "VV" denotes a large, complex, enveloped virus belonging to the poxvirus family. It has a linear, double-stranded DNA genome approximately 190 kbp in length, which encodes approximately 200 proteins. Vaccinia virus strains include, but are not limited to, strains of, derived from, or modified forms of Western Reserve (WR), Copenhagen (Cop), Bern, Paris, Tashkent, Tian Tan, Lister, Wyeth, IHD-J, IHD-W, Brighton, Ankara, modified vaccinia Ankara (MVA), CVA382, Dairen I, LIPV, LC16M8, LC16M0, LIVP, ACAM, WR 65-16, Connaught, JX-594 (pexastimogene devacirepvec), GL-ONC1, vvDD TK mutant, New York City Board of Health (NYCBH), EM-63, and NYVAC vaccinia virus strains.

As used herein, "marker" or "selection marker" in reference to engineered viruses refer to a compound, such as a protein, whose expression and/or presence within and/or on the surface of the virus permits selection of a virus with desired engineered properties, such as viruses that express a recombinantly expressed therapeutic gene or other protein, including a marker protein.

As used herein, Lister Strain of the Institute of Viral Preparations (LIVP) or LIVP virus strain refers to a virus strain that is the attenuated Lister strain (ATCC Catalog No. VR-1549) that was produced by adaption to calf skin at the Institute of Viral Preparations, Moscow, Russia (Al'tshtein et al. (1985) *Dokl. Akad. Nauk USSR* 285:696-699). The LIVP strain can be obtained, for example, from the Institute of Viral Preparations, Moscow, Russia (see, e.g., Kutinova et al. (1995) *Vaccine* 13:487-493); the Microorganism Collection of FSRI SRC VB Vector (Kozlova et al. (2010) *Environ. Sci. Technol.* 44:5121-5126); or can be obtained from the Moscow Ivanovsky Institute of Virology (C0355 K0602; Agranovski et al. (2006) *Atmospheric Environment* 40:3924-3929). It also is well-known to those of skill in the art; as it was the vaccine strain used for vaccination in the USSR and throughout Asia and India. The strain now is used by researchers and is well-known (see e.g., Altshteyn et al. (1985) *Dokl. Akad. Nauk USSR* 285:696-699; Kutinova et al. (1994) *Arch. Virol.* 134:1-9; Kutinova et al. (1995) Vaccine 13:487-493; Shchelkunov et al. (1993) *Virus Research* 28:273-283; Sroller et al. (1998) *Archives Virology* 143: 1311-1320; Zinoviev et al., (1994) *Gene* 147:209-214; and Chkheidze et al. (1993) FEBS 336:340-342). An LIVP virus strain encompasses any virus strain or virus preparation that is obtained by propagation of LIVP through repeat passage in cell lines.

As used herein, the "modified virus" refers to a virus that is altered compared to a parental strain of the virus. Typically modified viruses have one or more truncations, mutations, insertions or deletions in the genome of virus. A modified virus can have one or more endogenous viral genes modified and/or one or more intergenic regions modified. Exemplary modified viruses can have one or more heterologous nucleic acid sequences inserted into the genome of the virus. Modified viruses can contain one or more heterologous nucleic acid sequences in the form of a gene expression cassette for the expression of a heterologous gene.

Typically, the genome of the virus is modified by substitution (replacement), insertion (addition) or deletion (truncation) of nucleotides. Modifications can be made using any method known to one of skill in the art, including as provided herein, such as genetic engineering and recombinant DNA methods. Hence, a modified virus is a virus that is altered in its genome compared to the genome of a parental virus. Exemplary modified viruses have one or more heterologous nucleic acid sequences inserted into the genome of the virus. Generally the heterologous nucleic acid contains an open reading frame encoding a heterologous protein, which can be inserted under control of a viral promoter or a heterologous non-viral promoter. For example, modified viruses herein can contain one or more heterologous nucleic acid sequences in the form of a gene expression cassette for the expression of a heterologous gene.

As used herein, the term "carrier cell," used interchangeably with "cell," "cell vehicle," "carrier vehicle," cell-based delivery vehicle" and "cell-based vehicle" refers to any cell that can be or is infected with virus or otherwise associated with virus, such as through chemical or physical interaction between the virus and a surface protein, or by infection of the cytoplasm or nucleus of the cell with the virus. As used herein, a carrier cell refers to a cell that can be infected with a virus, such as an oncolytic virus, and in which a virus/oncolytic virus can replicate. The resulting carrier cell contains or is in association with an oncolytic virus.

As used herein, the term "cell-assisted viral expression system" or "cell-assisted viral enhancement system" (CAVES) refers to a carrier cell in association with a virus, generally an oncolytic virus, and at least one virus-encoded protein, such as an immunomodulatory or a therapeutic gene product, that is expressed by virtue of the association. The term "CAVES" is used interchangeably herein with the term "SNV." The carrier cell becomes associated with the virus by incubating the virus and cell under conditions in which the virus infects the cell so that viral proteins are expressed by the cell. By virtue of the virus, a carrier cell contains or presents on its surface at least one immunomodulatory protein or therapeutic gene product encoded by the virus. In exemplary embodiments, the CAVES provided herein are generated by ex vivo or in vitro incubation of the carrier cell with the virus for a period of time to achieve expression of the virally encoded immunomodulatory or therapeutic protein. The period of time is a function of the particular virus and cell, and is, between greater than about 2 hours and 72 hours or greater, generally between about 3 hours to about 72 hours, for example between about or at least 3, 4, 5 or 6 hours to about or at least 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 or more hours, and generally at a temperature that permits the expression of at least one virus-encoded immunomodulatory or therapeutic gene; generally about or at 37° C. The particular time and the temperature to facilitate such expression depend on the type of oncolytic virus used in the system. The CAVES is produced by virtue of expression of the virally encoded product, and replication of the virus in the cell. For most embodiments herein, the cells for the CAVES are not tumor cells and/or immune cells.

As used herein, "cryopreservation" refers to the process of cooling and storing cells, tissues, or organs at very low temperatures to maintain their viability. Typically cryopreservation is conducted at temperatures between about −80° C. to −200° C. Cryopreservation media are known to those of skill in the art. For example, such media generally contain the same formulation used to propagate the cells, plus, where cells have been propagated in serum-free medium, it is recommended to include fetal bovine serum up to a maximum of 20%, and a cryopreservative, such as DMSO (7%-10%) and/or glycerol (about 10%). The resulting composition is said to be cryopreserved.

As used herein, a "cryopreserved composition" is a composition that has been stored for at least 24 hours at cryopreservation temperatures.

As used herein, "multiplicity of infection (MOI)" refers to the number of virions that are added per cell during infection (i.e., one million virions added to one million cells is an MOI of one).

As used herein, "sensitized" or "sensitizing a cell" to alter a property of the cell, refers to treating the cell by treatment, generally before use, with an agent to modify a property of the cell, such as by inducing expression of a gene.

As used herein, amplification of a virus in a carrier cell means that the virus replicates in the cell to sustain the virus or increase the amount of virus in the cell.

As used herein, a "host cell" or "target cell" are used interchangeably to mean a cell that can be infected by a virus.

As used herein, the term "tissue" refers to a group, collection or aggregate of similar cells generally acting to perform a specific function within an organism.

As used herein, the term "immunomodulatory protein" or "immunomodulator" refers to a protein that is expressed by a virus that can protect the virus from attack by innate and/or acquired immune systems of the target cell, such as, for example, cells of the tumor. Viral immunomodulatory products have evolved to withstand the selective evolutionary pressure imposed by the host immune system. These products can modulate innate and adaptive host immune responses. Exemplary immunomodulatory products encoded by vaccinia, for example, include, but are not limited to, VCP (C3L), B5R, HA (A56R), B18R/B19R, B8R, CmrC and CmrE.

As used herein, the term, "therapeutic gene product" or "therapeutic polypeptide" refers to any heterologous protein expressed by a therapeutic gene encoded by a virus, such as an oncolytic virus, that ameliorates the symptoms of a disease or disorder or ameliorates the disease or disorder. Therapeutic gene products include, but are not limited to, moieties that inhibit cell growth or promote cell death, that can be activated to inhibit cell growth or promote cell death, or that activate another agent to inhibit cell growth or promote cell death. Optionally, the therapeutic agent can exhibit or manifest additional properties, such as, properties that permit its use as an imaging agent, as described elsewhere herein. Exemplary therapeutic gene products include, for example, immune checkpoint inhibitors, cytokines, growth factors, photosensitizing agents, radionuclides, toxins, anti-metabolites, signaling modulators, anti-cancer antibodies, angiogenesis inhibitors or a combination thereof.

As used herein, a "match" between a particular cell carrier (also referred to herein as a cell vehicle) and a subject with cancer to be treated with the carrier cell and virus means that the cell carrier is sufficiently compatible with the immune system of the host to evade the subject's immune system to deliver virus to a tumor in the subject. The carrier cell also can be matched to a virus, where a matched virus can replicate in the cell. A matched carrier cell with virus is a match for administration to a subject if the virus amplifies/replicates in the cell and the cell delivers virus to a tumor in the subject. Assays to identify carrier cells that are matched to a subject to be treated, and to identify matching carrier cell/virus combinations, are provided in U.S. Provisional Patent Application No. 62/680,570, and U.S. application Ser. No. 16/536,073, the contents of which are incorporated in their entirety by reference herein.

For purposes herein, recitation of "antibody" (e.g., antibody directed to an antigen expressed on an immune cell population such as, for example, T cells, γδ (gd) T cells, NK cells, and NKT cells to be depleted or inhibited for suppression of an immune response) includes full-length antibodies and portions thereof including antibody fragments. Antibody fragments, include, but are not limited to, Fab fragments, Fab' fragments, F(ab') 2 fragments, Fv fragments, disulfide-linked Fvs (dsFv), Fd fragments, Fd' fragments, single-chain Fvs (scFv), single-chain Fabs (scFab), diabodies, anti-idiotypic (anti-Id) antibodies, or antigen-binding fragments of any of the above. Antibody also includes synthetic antibodies, recombinantly produced antibodies, multispecific antibodies (e.g., bispecific antibodies), human antibodies, non-human antibodies, humanized antibodies, chimeric antibodies, and intrabodies. Antibodies provided herein include members of any immunoglobulin type (e.g., IgG, IgM, IgD, IgE, IgA and IgY), any class (e.g., IgG1, IgG2, IgG3, IgG4, IgAQ1 and IgA2) or subclass (e.g., IgG2a and IgG2b).

Antibodies, such as monoclonal antibodies, can be prepared using standard methods known to those with skill in the art (see, e.g., Kohler et al., *Nature* 256:495-497 (1975); Kohler et al., Eur. J. Immunol. 6:511-519 (1976); and WO 02/46455). For example, an animal is immunized by standard methods to produce antibody-secreting somatic cells. These cells then are removed from the immunized animal for fusion to myeloma cells. Somatic cells that can produce antibodies, particularly B cells, can be used for fusion with a myeloma cell line. These somatic cells can be derived from the lymph nodes, spleens and peripheral blood of primed animals. Specialized myeloma cell lines have been developed from lymphocytic tumors for use in hybridoma-producing fusion procedures (Kohler and Milstein, *Eur. J. Immunol.* 6:511-519 (1976); Shulman et al., *Nature,* 276: 269-282 (1978); Volk et al., *J. Virol.,* 42:220-227 (1982)). These cell lines have three useful properties. The first is they facilitate the selection of fused hybridomas from unfused and similarly indefinitely self-propagating myeloma cells by having enzyme deficiencies that render them incapable of growing in selective medium that support the growth of hybridomas. The second is they have the ability to produce antibodies and are incapable of producing endogenous light or heavy immunoglobulin chains. A third property is they efficiently fuse with other cells. Other methods for producing hybridomas and monoclonal antibodies are well known to those of skill in the art. It is routine to produce antibodies against any polypeptide, e.g., antigenic marker on an immune cell population, or an immune checkpoint.

As used herein, therapeutic agents are agents that ameliorate the symptoms of a disease or disorder or ameliorate the disease or disorder. Therapeutic agent, therapeutic compound, or therapeutic regimens include conventional drugs and drug therapies, including vaccines for treatment or prevention (i.e., reducing the risk of getting a particular disease or disorder), which are known to those skilled in the art and described elsewhere herein. Therapeutic agents for the treatment of neoplastic disease include, but are not limited to, moieties that inhibit cell growth or promote cell death, that can be activated to inhibit cell growth or promote cell death, or that activate another agent to inhibit cell growth or promote cell death. Therapeutic agents for use in the methods provided herein can be, for example, an anticancer agent. Exemplary therapeutic agents include, for example, therapeutic microorganisms, such as therapeutic viruses and bacteria, cytokines, growth factors, photosensitizing agents, radionuclides, toxins, antimetabolites, signaling modulators, anticancer antibiotics, anticancer antibodies, angiogenesis inhibitors, radiation therapy, chemotherapeutic compounds or a combination thereof.

As used herein, a tumor cell or cancer cell refers to a cell that divides and reproduces abnormally because growth and division are not regulated or controlled, i.e. cells that are susceptible to uncontrolled growth. A tumor cell can be a benign or malignant cell. Typically, the tumor cell is a malignant cell that can spread to other parts of the body, a process known as metastasis.

As used herein, a virus preparation or virus composition, refers to a virus composition obtained by propagation of a virus strain, for example a vaccinia virus strain, a vaccinia virus clonal strain or a modified or recombinant virus strain, in vivo or in vitro in a culture system. For example, a vaccinia virus preparation refers to a viral composition obtained by propagation of a virus strain in host cells, typically upon purification from the culture system using standard methods known in the art. A virus preparation generally is made up of a number of virus particles or virions. If desired, the number of virus particles in the sample or preparation can be determined using a plaque assay to calculate the number of plaque forming units per sample unit volume (pfu/mL), assuming that each plaque formed is representative of one infective virus particle. Each virus particle or virion in a preparation can have the same genomic sequence compared to other virus particles (i.e., the preparation is homogenous in sequence) or can have different genomic sequences (i.e., the preparation is heterogenous in sequence). It is understood to those of skill in the art that, in the absence of clonal isolation, heterogeneity or diversity in the genome of a virus can occur as the virus reproduces, such as by homologous recombination events that occur in the natural selection processes of virus strains (Plotkin & Orenstein (eds) "Recombinant Vaccinia Virus Vaccines" in Vaccines, 3rd edition (1999)).

As used herein, plaque forming unit (pfu) or infectious unit (IU) refers to the number of infectious or live viruses. It thus reflects the amount of active virus in the preparation. The pfu can be determined using a virus plaque assay (plaque formation assay) or an end-point dilution assay, which are standard assays known to one of skill in the art.

As used herein, "targeting molecule" or "targeting ligand" refers to any molecular signal directing localization to specific cells, tissues or organs. Examples of targeting ligands include, but are not limited to, proteins, polypeptides or portions thereof that bind to cell surface molecules, including, but not limited to, proteins, carbohydrates, lipids or other such moieties. For example, targeting ligands include proteins or portions thereof that bind to cell surface receptors or antibodies directed to antigens expressed selectively on a target cell. Targeting ligands include, but are not limited to growth factors, cytokines, adhesion molecules, neuropeptides, protein hormones and single-chain antibodies (scFv).

As used herein, a delivery vehicle for administration refers to a lipid-based or other polymer-based composition, such as liposome, micelle or reverse micelle, that associates with an agent, such as a virus provided herein, for delivery into a host subject.

As used herein, accumulation of a virus in a particular tissue refers to the distribution or colonization of the virus in particular tissues of a host organism after a time period following administration of the virus to the host, long enough for the virus to infect the host's organs or tissues. One skilled in the art recognizes that the time period for infection of a virus varies depending on the virus, the organ(s) or tissue(s) to be infected, the immunocompetence of the host, and the dosage of the virus. Generally, accumulation can be determined at time points from about less than 1 day, about 1 day to about 2, 3, 4, 5, 6 or 7 days, about 1 week to about 2, 3 or 4 weeks, about 1 month to about 2, 3, 4, 5, 6 months or longer after infection with the virus. For purposes herein, the viruses preferentially accumulate in immunoprivileged tissue, such as inflamed tissue or tumor tissue, but are cleared from other tissues and organs, such as non-tumor tissues, in the host to the extent that toxicity of the virus is mild or tolerable and at most, not fatal.

As used herein, "preferential accumulation" refers to accumulation of a virus at a first location at a higher level than accumulation at a second location (i.e., the concentration of viral particles, or titer, at the first location is higher than the concentration of viral particles at the second location). Thus, a virus that preferentially accumulates in immunoprivileged tissue (tissue that is sheltered from the immune system), such as inflamed tissue, and tumor tissue, relative to normal tissues or organs, refers to a virus that accumulates in immunoprivileged tissue, such as tumor, at a higher level (i.e., concentration or viral titer) than the virus accumulates in normal tissues or organs.

As used herein, activity refers to the in vitro or in vivo activities of a compound or virus provided herein. For example, in vivo activities refer to physiological responses that result following in vivo administration of a compound or virus provided herein (or of a composition or other mixture thereof). Activity, thus, encompasses resulting therapeutic effects and pharmaceutical activity of such compounds, compositions and mixtures. Activities can be observed in in vitro and/or in vivo systems designed to test or use such activities.

As used herein, "anti-tumor activity" or "anti-tumorigenic" refers to virus strains that prevent or inhibit the formation or growth of tumors in vitro or in vivo in a subject. Anti-tumor activity can be determined by assessing a parameter or parameters indicative of anti-tumor activity.

As used herein, "greater" or "improved" activity with reference to anti-tumor activity or anti-tumorigenicity means that a virus strain is capable of preventing or inhibiting the formation or growth of tumors in vitro or in vivo in a subject to a greater extent than a reference or control virus or to a greater extent than absence of treatment with the virus. Whether anti-tumor activity is "greater" or "improved" can be determined by assessing the effect of a virus and, if necessary, a control or reference virus, on a parameter indicative of anti-tumor activity. It is understood that when comparing the activity of two or more different viruses, the amount of virus (e.g., pfu) used in an in vitro assay or administered in vivo is the same or similar, and the conditions (e.g., in vivo dosage regimen) of the in vitro assay or in vivo assessment are the same or similar.

As used herein, "toxicity" (also referred to as virulence or pathogenicity herein) with reference to a virus refers to the deleterious or toxic effects to a host upon administration of the virus. For an oncolytic virus, such as vaccinia virus, the toxicity of a virus is associated with its accumulation in non-tumorous organs or tissues, which can impact the survival of the host or result in deleterious or toxic effects. Toxicity can be measured by assessing one or more parameters indicative of toxicity. These include accumulation in non-tumorous tissues and effects on viability or health of the subject to whom it has been administered, such as effects on body weight.

As used herein, "reduced toxicity" means that the toxic or deleterious effects upon administration of the virus to a host are attenuated or lessened compared to a host not treated with the virus or compared to a host that is administered with another reference or control virus. Whether toxicity is reduced or lessened can be determined by assessing the effect of a virus and, if necessary, a control or reference virus, on a parameter indicative of toxicity. It is understood that when comparing the activity of two or more different viruses, the amount of virus (e.g., pfu) used in an in vitro assay or administered in vivo is the same or similar and the conditions (e.g., in vivo dosage regimen) of the in vitro assay or in vivo assessment are the same or similar. For example, when comparing effects upon in vivo administration of a virus and a control or reference virus the subjects are the same species, size, gender and the virus is administered in the same or similar amount under the same or similar dosage regimen. In particular, a virus with reduced toxicity can mean that upon administration of the virus to a host, such as for the treatment of a disease, the virus does not accumulate in non-tumorous organs and tissues in the host to an extent that results in damage or harm to the host, or that impacts survival of the host to a greater extent than the disease being treated does or to a greater extent than a control or reference virus does. For example, a virus with reduced toxicity includes a virus that does not result in death of the subject over the course of treatment.

As used herein, a "control" or "standard" refers to a sample that is substantially identical to the test sample, except that it is not treated with a test parameter, or, if it is a plasma sample, it can be from a normal volunteer not affected with the condition of interest. A control also can be an internal control. For example, a control can be a sample, such as a virus, that has a known property or activity.

As used herein, dosing regimen refers to the amount of agent, for example, a carrier cell or virus or other agent, administered, and the frequency of administration over the course of a cycle of administration. The dosing regimen is a function of the disease or condition to be treated, and thus can vary.

As used herein, frequency of administration refers to the number of times an agent is administered during the cycle of administration. For example, frequency can be days, weeks or months. For example, frequency can be administration once during a cycle of administration, two times, three times, four times, five times, six times or seven times. The frequency can refer to consecutive days during the cycle of administration. The particular frequency is a function of the particular disease or condition treated.

As used herein, a "cycle of administration" refers to the repeated schedule of the dosing regimen of administration of a virus that is repeated over successive administrations. For example, an exemplary cycle of administration is a 28-day cycle.

As used herein, immunoprivileged cells and immunoprivileged tissues refer to cells and tissues, such as solid tumors, which are sequestered from the immune system. An immunoprivileged cell or tissue tolerates the introduction of antigens without eliciting an inflammatory immune response. For example, administration of a virus to a subject elicits an immune response that clears the virus from the subject. Immunoprivileged sites, however, are shielded or sequestered from the immune response, permitting the virus to survive and generally to replicate. Immunoprivileged tissues include proliferating tissues, such as tumor tissues and other tissues and cells involved in other proliferative disorders, wounds and other tissues involved in inflammatory responses.

As used herein, a tumor, also known as a neoplasm, is an abnormal mass of tissue that results when cells proliferate at an abnormally high rate. Tumor encompass hematopoietic tumors as well as solid tumors. Tumors can show partial or total lack of structural organization and functional coordination with normal tissue. Tumors can be benign (not cancerous), or malignant (cancerous).

As used herein, malignant, as applied to tumors, refers to primary tumors that have the capacity of metastasis with loss of growth control and positional control.

As used herein, metastasis refers to a growth of abnormal or neoplastic cells distant from the site primarily involved by the morbid process.

As used herein, malignant tumors can be broadly classified into three major types. Carcinomas are malignant tumors arising from epithelial structures, such as, but not limited to, breast, prostate, lung, colon, and pancreas. Sarcomas are malignant tumors that originate from connective tissues, or mesenchymal cells, such as muscle, cartilage, fat or bone. Leukemias and lymphomas are malignant tumors affecting hematopoietic structures (structures pertaining to the formation of blood cells), including components of the immune system. Other malignant tumors include, but are not limited to, tumors of the nervous system (e.g., neurofibromatomas), germ cell tumors, and blastic tumors.

As used herein, a resected tumor refers to a tumor in which a significant portion of the tumor has been excised. The excision can be effected by surgery (i.e., a surgically resected tumor). The resection can be partial or complete.

As used herein, a disease or disorder refers to a pathological condition in an organism resulting from, for example, infection or genetic defect, and characterized by identifiable symptoms. An exemplary disease as described herein is a neoplastic disease, such as cancer.

As used herein, neoplastic disease refers to any disorder involving cancer, including tumor development, growth, metastasis and progression.

As used herein, cancer is a term for diseases caused by or characterized by any type of malignant tumor or hematological malignancy, including metastatic cancers, lymphatic tumors, and blood cancers. Exemplary cancers include, but are not limited to, acute lymphoblastic leukemia, acute lymphoblastic leukemia, acute myeloid leukemia, acute promyelocytic leukemia, adenocarcinoma, adenoma, adrenal cancer, adrenocortical carcinoma, AIDS-related cancer, AIDS-related lymphoma, anal cancer, appendix cancer, astrocytoma, basal cell carcinoma, bile duct cancer, bladder cancer, bone cancer, osteosarcoma/malignant fibrous histiocytoma, brainstem glioma, brain cancer, carcinoma, cerebellar astrocytoma, cerebral astrocytoma/malignant glioma, ependymoma, medulloblastoma, supratentorial primitive neuroectodermal tumor, visual pathway or hypothalamic glioma, breast cancer, bronchial adenoma/carcinoid, Burkitt's lymphoma, carcinoid tumor, carcinoma, central nervous system lymphoma, cervical cancer, chronic lymphocytic leukemia, chronic myelogenous leukemia, chronic myeloproliferative disorder, colon cancer, cutaneous T-cell lymphoma, desmoplastic small round cell tumor, endometrial cancer, ependymoma, epidermoid carcinoma, esophageal cancer, Ewing's sarcoma, extracranial germ cell tumor, extragonadal germ cell tumor, extrahepatic bile duct cancer, eye cancer/intraocular melanoma, eye cancer/retinoblastoma, gallbladder cancer, gallstone tumor, gastric/stomach cancer, gastrointestinal carcinoid tumor, gastrointestinal stromal tumor, giant cell tumor, glioblastoma multiforme, glioma, hairy-cell tumor, head and neck cancer, heart cancer, hepatocellular/liver cancer, Hodgkin's lymphoma, hyperplasia, hyperplastic corneal nerve tumor, in situ carcinoma, hypopharyngeal cancer, intestinal ganglioneuroma, islet cell tumor, Kaposi's sarcoma, kidney/renal cell cancer, laryngeal cancer, leiomyoma tumor, lip and oral cavity cancer, liposarcoma, liver cancer, non-small cell lung cancer, small cell lung cancer, lymphomas, macroglobulinemia, malignant carcinoid, malignant fibrous histiocytoma of bone, malignant hypercalcemia, malignant melanomas, marfanoid habitus tumor, medullary carcinoma, melanoma, merkel cell carcinoma, mesothelioma, metastatic skin carcinoma, metastatic squamous neck cancer, mouth cancer, mucosal neuromas, multiple myeloma, mycosis fungoides, myelodysplastic syndrome, myeloma, myeloproliferative disorder, nasal cavity and paranasal sinus cancer, nasopharyngeal carcinoma, neck cancer, neural tissue cancer, neuroblastoma, oral cancer, oropharyngeal cancer, osteosarcoma, ovarian cancer, ovarian epithelial tumor, ovarian germ cell tumor, pancreatic cancer, parathyroid cancer, penile cancer, pharyngeal cancer, pheochromocytoma, pineal astrocytoma, pineal germinoma, pineoblastoma, pituitary adenoma, pleuropulmonary blastoma, polycythemia vera, primary brain tumor, prostate cancer, rectal cancer, renal cell tumor, reticulum cell sarcoma, retinoblastoma, rhabdomyosarcoma, salivary gland cancer, seminoma, Sezary syndrome, skin cancer, small intestine cancer, soft tissue sarcoma, squamous cell carcinoma, squamous neck carcinoma, stomach cancer, supratentorial primitive neuroectodermal tumor, testicular cancer, throat cancer, thymoma, thyroid cancer, topical skin lesion, trophoblastic tumor, urethral cancer, uterine/endometrial cancer, uterine sarcoma, vaginal cancer, vulvar cancer, Waldenström's macroglobulinemia or Wilm's tumor. Exemplary cancers commonly diagnosed in humans include, but are not limited to, cancers of the bladder, brain, breast, bone marrow, cervix, colon/rectum, kidney, liver, lung/bronchus, ovary, pancreas, prostate, skin, stomach, thyroid, or uterus. Exemplary cancers commonly diagnosed in dogs, cats, and other pets include, but are not limited to, lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma (e.g., granulocytic sarcoma), corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma and cystadenoma, follicular lymphoma, intestinal lymphosarcoma, fibrosarcoma and pulmonary squamous cell carcinoma. Exemplary cancers diagnosed in rodents, such as a ferret, include, but are not limited to, insulinoma, lymphoma, sarcoma, neuroma, pancreatic islet cell tumor, gastric MALT lymphoma and gastric adenocarcinoma. Exemplary neoplasias affecting agricultural livestock include, but are not limited to, leukemia, hemangiopericytoma and bovine ocular neoplasia (in cattle); preputial fibrosarcoma, ulcerative squamous cell carcinoma, preputial carcinoma, connective tissue neoplasia and mastocytoma (in horses); hepatocellular carcinoma (in swine); lymphoma and pulmonary adenomatosis (in sheep); pulmonary sarcoma, lymphoma, Rous sarcoma, reticuloendotheliosis, fibrosarcoma, nephroblastoma, B-cell lymphoma and lymphoid leukosis (in avian species); retinoblastoma, hepatic neoplasia, lymphosarcoma (lymphoblastic lymphoma), plasmacytoid leukemia and swimbladder sarcoma (in fish), caseous lymphadenitis (CLA): chronic, infectious, contagious disease of sheep and goats caused by the bacterium *Corynebacterium pseudotuberculosis*, and contagious lung tumor of sheep caused by jaagsiekte.

As used herein, a cell involved in a disease or disease process refers to cells whose presence contributes to, exacerbates, causes or otherwise is involved in the etiology of a disease or disease process. Inhibition or killing of such cells can ameliorate the symptoms of the disease or can ameliorate the disease. Examples of such cells are tumor cells. Killing or inhibiting the growth or proliferation of tumor cells effects treatment of tumors. Other examples are immune effector cells, which participate in inflammatory responses that contribute to the pathology of a variety of diseases. Inhibiting or killing immune effector cells can treat diseases that have an inflammatory component.

As used herein, "killing or inhibiting growth or proliferation of cells" means that the cells die or are eliminated. Inhibiting growth or proliferation means that the number of such cells does not increase, and can decrease.

As used herein, a "tumor cell" is any cell that is part of a tumor. Typically, carrier cells provided herein preferentially home to tumor cells and the viruses provided herein preferentially infect tumor cells in a subject compared to normal cells.

As used herein, a "metastatic cell" is a cell that has the potential for metastasis. Metastatic cells have the ability to metastasize from a first tumor in a subject and can colonize tissue at a different site in the subject to form a second tumor at the site.

As used herein, "tumorigenic cell," is a cell that, when introduced into a suitable site in a subject, can form a tumor. The cell can be non-metastatic or metastatic.

As used herein, a "normal cell" is a cell that is not derived from a tumor, but is derived from healthy non-diseased tissue.

As used herein, a "metastasis" refers to the spread of cancer from one part of the body to another. For example, in the metastatic process, malignant cells can spread from the site of the primary tumor in which the malignant cells arose and move into lymphatic and blood vessels, which transport the cells to normal tissues elsewhere in an organism where the cells continue to proliferate. A tumor formed by cells that have spread by metastasis is called a "metastatic tumor," a "secondary tumor" or a "metastasis."

As used herein, an anti-cancer agent or compound (used interchangeably with "anti-tumor or anti-neoplastic agent") refers to any agents or compounds used in anti-cancer treatment. These include any agents, when used alone or in combination with other compounds, that can alleviate, reduce, ameliorate, prevent, or place or maintain in a state of remission of clinical symptoms or diagnostic markers associated with neoplastic disease, tumors and cancer, and can be used in methods, combinations and compositions provided herein. Anticancer agents include antimetastatic agents. Exemplary anticancer agents include, but are not limited to, chemotherapeutic compounds, such as, but not limited to toxins, alkylating agents, nitrosoureas, anticancer antibiotics, antimetabolites, antimitotics, and topoisomerase inhibitors, cytokines, growth factors, hormones, photosensitizing agents, radionuclides, signaling modulators, immunotherapeutic agents, CAR-T cells, checkpoint inhibitors, CRISPR therapies, anticancer antibodies, anticancer oligopeptides, anticancer oligonucleotides (e.g., antisense RNA and RNAi, such as siRNA and shRNA), angiogenesis inhibitors, radiation therapy, or a combination thereof. Exemplary chemotherapeutic compounds include, but are not limited to, Ara-C, cisplatin, carboplatin, paclitaxel, doxorubicin, gemcitabine, camptothecin, irinotecan, cyclophosphamide, 6-mercaptopurine, vincristine, 5-fluorouracil, and methotrexate.

As used herein, reference to an anticancer or chemotherapeutic agent includes combinations or a plurality of anticancer or chemotherapeutic agents unless otherwise indicated.

As used herein, a subject includes any organism, including an animal for whom diagnosis, screening, monitoring or treatment is contemplated. Animals include mammals such as primates and domesticated animals. An exemplary primate is a human. A patient refers to a subject, such as a mammal, primate, human, or livestock subject afflicted with a disease condition or for which a disease condition is to be determined or risk of a disease condition is to be determined.

As used herein, a patient refers to a human subject exhibiting symptoms of a disease or disorder.

As used herein, treatment of a subject that has a condition, disorder or disease means any manner of treatment in which the symptoms of the condition, disorder or disease are ameliorated or otherwise beneficially altered. Treatment encompasses any pharmaceutical use of the cell-assisted viral expression systems described and provided herein.

As used herein, treatment of a subject that has a neoplastic disease, including a tumor or metastasis, means any manner of treatment in which the symptoms of having the neoplastic disease are ameliorated or otherwise beneficially altered. Typically, treatment of a tumor or metastasis in a subject encompasses any manner of treatment that results in slowing of tumor growth, lysis of tumor cells, reduction in the size of the tumor, prevention of new tumor growth, or prevention of metastasis of a primary tumor, including inhibition of vascularization of the tumor, tumor cell division, tumor cell migration or degradation of the basement membrane or extracellular matrix.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, amelioration or alleviation of the symptoms of a particular disorder, such as by administration of a particular pharmaceutical composition, refers to any lessening, whether permanent or temporary, lasting or transient that can be attributed to or associated with administration of the composition.

As used herein, efficacy means that upon administration of a virus or virus composition, the virus will colonize proliferating or immunoprivileged cells, such as tumor cells, and replicate. Colonization and replication in tumor cells is indicative that the treatment is or will be an effective treatment.

As used herein, effective treatment with a cell carrier/virus is one that can increase survival compared to the absence of treatment therewith. For example, a virus is an effective treatment if it stabilizes disease, causes tumor regression, decreases severity of disease or slows down or reduces metastasizing of the tumor.

As used herein, an effective amount, or therapeutically effective amount, of a virus or compound for treating a particular disease is an amount to ameliorate, or in some manner reduce the symptoms associated with the disease. The amount will vary from one individual to another and will depend upon a number of factors, including, but not limited to, age, weight, the overall physical condition of the patient, and the severity of the disease. A therapeutically effective amount can be administered as a single dosage or can be administered in multiple dosages according to a regimen, whereby it is effective. The amount can cure the disease but, typically, is administered in order to ameliorate the symptoms of the disease. Repeated administration can be required to achieve the desired amelioration of symptoms.

As used herein, an effective amount, or therapeutically effective amount, of a virus or compound for treating a neoplastic disease, including a tumor or metastasis is an amount to ameliorate, or in some manner reduce the symptoms associated with the neoplastic disease, including, but not limited to slowing of tumor growth, lysis of tumor cells, reduction in the size of the tumor, prevention of new tumor growth, or prevention of metastasis of a primary tumor.

As used herein, prevent a disease or condition means reduce the probability or rise of getting the disease or condition.

As used herein, a “composition” refers to any mixture of two or more products or compounds. It can be a solution, a suspension, liquid, powder, a paste, aqueous, non-aqueous, or any combination thereof.

As used herein, a formulation refers to a composition containing at least one active pharmaceutical or therapeutic agent and one or more excipients.

As used herein, a co-formulation refers to a composition containing two or more active or pharmaceutical or therapeutic agents and one or more excipients.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related. Exemplary combinations include, but are not limited to, two or more pharmaceutical compositions, a composition containing two or more active ingredients, such as two viruses, or a virus and an anticancer agent, such as a chemotherapeutic compound, two or more viruses, a virus and a therapeutic agent, a virus and an imaging agent, a virus and a plurality of therapeutic and/or imaging agents, or any association thereof. Such combinations can be packaged as kits.

As used herein, a composition refers to a mixture of two or more components, such as a therapeutic agent in or mixed with a pharmaceutically acceptable vehicle.

As used herein, direct administration refers to administration of a composition without dilution.

As used herein, a kit is a packaged combination, optionally, including instructions for use of the combination and/or other reactions and components for such use.

As used herein, an “article of manufacture” is a product that is made and sold. As used throughout this application, the term is intended to encompass articles containing a carrier cell and vaccinia virus alone or in combination with a second therapy or a therapeutic energy source contained in the same or separate articles of packaging.

As used herein, a device refers to a thing made or adapted for a particular task. Exemplary devices herein are devices that cover or coat or are capable of contacting the epidermis or surface of the skin. Examples of such devices include, but are not limited to, a wrap, bandage, bind, dress, suture, patch, gauze or dressing.

As used herein, the singular forms “a,” “an” and “the” include plural referents unless the context clearly dictates otherwise.

As used herein, ranges and amounts can be expressed as “about” or “approximately” a particular value or range. “About” or “approximately” also includes the exact amount. Hence, “about 5 milliliters” means “about 5 milliliters” and also “5 milliliters.” Generally “about” includes an amount that expected to be within experimental error.

As used herein, “about the same” means within an amount that one of skill in the art considers to be the same or to be within an acceptable range of error. For example, typically, for pharmaceutical compositions, within at least 1%, 2%, 3%, 4%, 5% or 10% is considered about the same. Such amounts can vary depending upon the tolerance for variation in the particular composition by subjects.

As used herein, “optional” or “optionally” means that the subsequently described event or circumstance does or does not occur, and that the description includes instances where said event or circumstance occurs and instances where it does not.

As used herein, “allogeneic cells” are cells that are genetically different with respect to a particular subject because they are derived from genetically different individual, generally of the same species. For example, allogeneic stem cells are stem cells that are derived from a donor other than the patient (or identical twin).

As used herein, “autologous cells” are cells obtained from the individual to be treated with the cells. For example, autologous cells are obtained from the subject to be treated (i.e., the patient). For example, autologous stem cells are stem cells that are derived from the patient.

As used herein, the term “engineered,” with respect to cell vehicles or carrier cells, denotes the genetic modification of the cells, such that they express proteins that can improve or enhance the performance of the cells. For example, cells can be engineered for improved viral amplification and/or improved immunomodulation.

As used herein, “immunomodulation” refers to any process in which an immune response is modified to a desired level, for example by inducing, enhancing or suppressing an immune response.

As used herein, “'immune suppression” or “immunosuppression” refers to the suppression or reduction of the immune response.

As used herein, “immune privileged” or “immunoprivileged” refers to cells or tissues that do not elicit an immune response and can evade the immune system. Immunoprivileged cells and tissues refer to cells and tissues, such as solid tumors and the tumor microenvironment, which are sequestered from the immune system by virtue of immunosuppressive properties of tumors. As a result, oncolytic viruses preferentially accumulate in tumors in the tumor microenvironment because they are shielded from the immune system. Immunoprivileged tissues and cells, however, are shielded or sequestered from the immune response, permitting the viruses to survive and generally to replicate.

As used herein, "disease or disorder" refers to a pathological condition in an organism resulting from, for example, infection or genetic defect, and characterized by identifiable symptoms.

As used herein, "resistant" with respect to viral infection refers to a cell that is not infected, or is infected to a very low degree, with a virus upon exposure to the virus.

As used herein, "permissive" with respect to viral infection refers to a cell that is readily infected upon exposure to the virus.

As used herein, immunologically compatible refers to a cell or virus that is sufficiently compatible with the immune system of the subject/host, to evade the subject's immune system for a sufficient time to deliver virus to a tumor or cancerous cell in the subject.

As used herein, "co-culture" refers to a cell culture in which two or more different populations of cells are grown.

As used herein the term "loading," with respect to cells, can refer to the association of a cell with an agent, such as, for example, a virus, small molecule, therapeutic agent, and antibody or antigen binding fragment of thereof, through a chemical or physical interaction between the cell and the agent on the surface of the cell or inside the cell.

As used herein, adipose-derived stem cells or ADSCs are mesenchymal stem cells that are obtained from the adipose tissue of a donor.

As used herein, a peripheral blood mononuclear cell or PBMC is any peripheral blood cell having a round nucleus, for example, lymphocytes, monocytes or macrophages.

As used herein, "L14 VV" or "CAL14 VV" is a TK-inserted Turbo-FP635 engineered LIVP strain of vaccinia virus.

As used herein, "ACAM2000," which has the same genomic sequence as ACAM1000 (ACAM1000, which is deposited as ATCC Deposit No. PTA-3321; see, U.S. Pat. Nos. 6,723,325, 7,115,270 and 7,645,456) is a wild type thymidine kinase (TK)-positive Wyeth strain of vaccinia virus. It is a smallpox vaccine strain that is available from the CDC. ACAM1000 is the designation of the virus when propagated in MRC5 cells; ACAM2000 is the designation of the virus when propagated in Vero cells. In embodiments, the ACAM2000 virus has the sequence set forth in SEQ ID NO: 70.

As used herein, "CAL-01" or "CAL1" or "WT1," used interchangeably herein, designates a virus that is amplified or cultured from ACAM2000 or ACAM1000. In exemplary embodiments, the CAL1 virus has the sequence set forth in SEQ ID NO:71.

As used herein, "CAL-02" or "CAL2," used interchangeably herein, designate a recombinant form of an ACAM2000 or CAL1 virus that encodes an exogenous gene, e.g., OX40L, 4-IBBL, single chain antibody against checkpoint inhibitor, such as, for example, CTLA-4.

As used herein, "CAL-03" or "CAL3," used interchangeably herein, designate a recombinant form of an ACAM2000, CAL1 or CAL2 virus that expresses an anti-angiogenesis gene, such as a single chain antibody against VEGF, optionally in conjunction with one or more other exogenous genes, e.g., OX40L, 4-IBBL, single chain antibody against checkpoint inhibitors, such as, for example, CTLA-4.

As used herein, "SNV-1" or "SNV1," used interchangeably herein, refer to CAVES (or SNVs) that are formed by incubating the CAL-01 virus with a cell carrier, such as a stem cell. When $1\times10^7$ pfu of the virus is incubated with the cell carrier, the resulting SNV is designated SNV-la (or SNVla). When $1\times10^6$ pfu of the virus is incubated with the cell carrier, the resulting SNV is designated SNV-1b (or SNV1b). When $1\times10^5$ pfu of the virus is incubated with the cell carrier, the resulting SNV is designated SNV-1c (or SNV1c).

As used herein, "SNV-2" or "SNV2," used interchangeably herein, refer to CAVES (or SNVs) that are formed by incubating the CAL-02 virus with a cell carrier, such as a stem cell. When $1\times10^7$ pfu of the virus is incubated with the cell carrier, the resulting SNV is designated SNV-2a (or SNV2a). When $1\times10^6$ pfu of the virus is incubated with the cell carrier, the resulting SNV is designated SNV-2b (or SNV2b). When $1\times10^5$ pfu of the virus is incubated with the cell carrier, the resulting SNV is designated SNV-2c (or SNV2c).

As used herein, "SNV-3" or "SNV3," used interchangeably herein, refer to CAVES or SNVs that are formed by incubating the CAL-03 virus with a cell carrier, such as a stem cell. When $1\times10^7$ pfu of the virus is incubated with the cell carrier, the resulting SNV is designated SNV-3a (or SNV3a). When $1\times10^6$ pfu of the virus is incubated with the cell carrier, the resulting SNV is designated SNV-3b (or SNV3b). When $1\times10^5$ pfu of the virus is incubated with the cell carrier, the resulting SNV is designated SNV-3c (or SNV3c).

As used herein, a virus plaque assay (VPA) is an assay used to determine the quantity of infectious virus or the viral titer, given as plaque-forming units (pfu) per m1 or per sample.

As used herein, a "primed" or "protected" cell vehicle or carrier cell is one that has been pre-treated and/or loaded with an agent, such as a cytokine, for example interferon (IFN), or antagonists of allogeneic inactivation/rejection determinants, to protect the cell from the immune response.

As used herein, treatment refers to amelioration of the symptoms of a disease or disorder.

As used herein, prevention refers to prophylactic treatment to reduce the risk of getting a disease or condition or reducing the severity thereof.

As used herein, a subject refers to any mammal that can be treated by the methods and uses herein. Mammals include humans, other primates, such as chimpanzees, bonobos, and gorillas, dogs, cats, cows, pigs, goats and other farm animals and pets. Patients refer to human subjects.

As used herein, "inactivation" of a gene or genetic locus means that the expression of one or more products encoded by the gene or locus is partially or completely inhibited, e.g., by 10% or more, generally by 50% or more, e.g., about or at 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99 or 100%. The inactivation can be effected, e.g., by partial or complete truncation of a locus and/or by insertion of an exogenous gene, such as therapeutic gene.

As used herein, the abbreviations for any protective groups, amino acids and other compounds are, unless indicated otherwise, in accord with their common usage, recognized abbreviations, or the IUPAC-IUB Commission on Biochemical Nomenclature (see, (1972) Biochem. 11:1726).

For clarity of disclosure, and not by way of limitation, the detailed description is divided into the subsections that follow.

B. Selection of Components for Cell-Assisted Viral Expression Systems (CAVES)

Cells have been used as carriers for oncolytic virus for therapy. It had been understood that virus is loaded in the cells ex vivo with the objective of loading as many viruses per cell as possible (see, e.g., Kim et al. (2015) *Viruses*

7:6200-6217). Generally a multiplicity of infection (MOI) of at least 200 or more viruses/cell are used to achieve this. Also, it had been understood that viruses should be loaded as rapidly as possible to avoid any premature initation of viral replication, which reduces viability of the cell carrier, and also increases untimely presentation of viral antigens on the surface of the cell, which leads to elimination by the host immune system (see, e.g., Kim et al. (2015) *Viruses* 7:6200-6217). It is shown herein that this prior understanding is incorrect. It is shown herein that infection of the cells should be performed at low MOI, generally less than 10, such as 0.1 or lower up to about 1 MOI/cell, and that incubation of virus with cells should proceed sufficiently long for viral replication to commence, and expression of viral genes, such as immunomodulatory gene products and therapeutic products, to be expressed. Generally the cells containing virus provided herein contain at the time of administration, or freezing or storing by refrigeration, for future use, should contain fewer than about 100 virus particles/cell, and should express virally encoded proteins. The particular amount of virus depends upon the selected cells and the virus. For example, for vaccinia virus and stem cells, such as MSCs or cells from adipose SVF, should be incubated for at least 6 hours, and up to about 35, about 40, or about 50 hours. The initial MOI should be less than 10 pfu/cell, such as 0.1 to 10, or 0.01 to 10, or 0.1 to 1 virus particle/cell. Generally the cells are stem cells or primary cells, such as fibroblasts, and are not cancer cells, including inactivated cancer cells, and/or immune cells.

1. Cells

Oncolytic viruses (OVs) have the ability to preferentially accumulate in and replicate in and kill tumor cells, relative to normal cells. This ability can be a native feature of the virus (e.g., pox virus, reovirus, Newcastle disease virus and mumps virus), or the viruses can be modified or selected for this property. Viruses can be genetically attenuated or modified so that they can circumvent antiviral immune and other defenses in the subject (e.g., vesicular stomatitis virus, herpes simplex virus, adenovirus) so that they preferentially accumulate in tumor cells or the tumor microenvironment, and/or the preference for tumor cells can be selected for or engineered into the virus using, for example, tumor-specific cell surface molecules, transcription factors and tissue-specific microRNAs (see, e.g., Cattaneo et al., *Nat. Rev. Microbiol.,* 6 (7): 529-540 (2008); Dorer et al., *Adv. Drug Deliv. Rev.,* 61 (7-8): 554-571 (2009); Kelly et al., *Mol. Ther.,* 17 (3): 409-416 (2009); and Naik et al., *Expert Opin. Biol. Ther.,* 9 (9): 1163-1176 (2009)).

Delivery of oncolytic viruses can be effected via direct intratumoral injection. While direct intratumoral delivery can minimize the exposure of normal cells to the virus, there often are limitations due to, e.g., inaccessibility of the tumor site (e.g., brain tumors) or for tumors that are in the form of several small nodules spread out over a large area or for metastatic disease. Viruses can be delivered via systemic or local delivery, such as by intravenous administration, or intraperitoneal administration, and other such routes. Systemic delivery can deliver virus not only to the primary tumor site, but also to disseminated metastases.

Regardless of the mode of delivery, however, the success of treatment using oncolytic viruses can be compromised by the host's immune system, which can induce an immune response and neutralize the virus (Kerrigan et al. (2017) *Cytotherapy* 19 (4): 445-457; Roy and Bell (2013) *Oncolytic Virotherapy* 2:47-56). For example, intravenously delivered viruses are exposed to complement and various immune cells, and antibodies, and are sequestered and subsequently cleared in organs such as the lung, spleen and liver (Roy and Bell (2013) *Oncolytic Virotherapy* 2:47-56). A host's immune system has evolved to eliminate viruses. For example, neutralizing antibodies (NAbs) bind viruses, block the attachment of viruses to cell surface receptors and inhibit viral infection, thus limiting the therapeutic potential of administered therapeutic viruses (Jennings et al. (2014) *Int. J. Cancer* 134:1091-1101). In addition to the innate immune response, previous exposure, resulting in adaptive immunity, can be more specific and potent and also limiting of the therapeutic potential of OVs. Physical barriers, such as the extracellular matrix and high interstitial fluid pressure of tumors, can prevent the efficient delivery of viral particles to tumor cells (Roy and Bell (2013) *Oncolytic Virotherapy* 2:47-56).

A majority of human individuals have been exposed to a number of viruses, including measles virus, adenovirus, vaccinia virus, and reovirus, and as a result, exhibit pre-existing antiviral immunity, which can diminish the therapeutic potential of oncolytic virotherapy. For example, most subjects, born before the mid-1970's, have been vaccinated against smallpox, resulting in pre-existing antiviral immunity against orthopoxviruses, including vaccinia virus. Even if a subject does not already possess pre-existing immunity to a specific OV, the initial dose of virus results in an anti-viral immune response, limiting the effectiveness of repeated doses, which can be required to achieve a potent anti-tumor response. Strategies to circumvent this include the use of immune suppressants, such as cyclophosphamide, and the use of carrier cells (cell vehicles) to bypass the immune system and deliver OVs to tumor sites.

Transient immunosuppression using immunosuppressive drugs, such as cyclophosphamide, tacrolimus, mycophenolate mofetil and methylprednisolone sodium succinate, have been used in organ transplantation, but have limited success in enhancing the tumoral delivery of systemically administered OVs (Guo et al. (2010) *Gene Ther.* 17 (12): 1465-1475). The use of immunosuppressive drugs also can increase the potential toxicity of viruses and, in addition, can reduce any antitumor responses mounted by the immune system that would otherwise aid in oncolysis (Thorne et al. (2010) *Molecular Therapy* 18 (9): 1698-1705).

Carrier cells have been used for the delivery of OVs. Carrier cells can mimic the way viruses have evolved to spread within the host. For example, the human immunodeficiency virus binds to circulating dendritic cells (DCs) and macrophages, which can migrate to the lymph nodes and allow the virus to reach its target: $CD4^{+}$T cells. Additionally, viruses that replicate by spreading from cell to cell can evade neutralizing antibodies. Clinical trials have shown that oncolytic reovirus, upon intravenous administration, binds circulating cells, retaining its infectivity and reaches tumor cells even in the presence of neutralizing antibodies (Roy and Bell (2013) *Oncolytic Virotherapy* 2:47-56). Advantages of using cell-based vehicles include the specific delivery of OVs to tumor cells, increasing their therapeutic potential and preventing off-target toxicities, and the ability to shield the OVs from pre-existing antiviral immunity.

The effectiveness of a carrier cell for the delivery of an OV relies on several factors, including, but not limited to: (1) ex vivo loading of the virus; (2) in vivo accumulation of the virus at the tumor site; and (3) virus amplification/production at the tumor site (Guo et al. (2010) *Gene Ther.* 17 (12): 1465-1475). The ideal carrier cell not only shields the OV from neutralization by the immune system, but also specifically delivers it to the tumor and possesses antitumor activity of its own. The carrier cell should be safe to administer, easy to isolate and/or manufacture, be susceptible to infection by the virus, allow the virus to replicate, and release the virus at the tumor site before being destroyed.

For the CAVES provided herein, the carrier cells, in addition to being effective for delivery of an OV, must be able to promote ex vivo amplification (replication) of the virus and the expression of at least one virus-encoded immunomodulatory protein and/or a recombinantly expressed therapeutic protein. In the systems provided herein, a cell, such as a carrier cell, is incubated with a virus for a predetermined amount of time that permits ex vivo replication (amplification) of the virus and the expression of at least one virus-encoded immunomodulatory protein and/or a recombinantly expressed therapeutic protein. The amount of time can vary, for example, from more than 2 hours, e.g., 3 or more hours, more than 4 hours, e.g., 6 –48 hours to e.g., 72 or more hours, depending on the replication cycle of the virus. For example, VSV is a rapidly replicating virus, and delivery via carrier cells can be achieved if the cells are injected after 1-2 hours of infection. With slower replicating viruses such as vaccinia virus, there is more flexibility in optimizing the timing for infection and delivery of the carrier cells.

The cells used in the systems provided herein can be autologous or allogeneic. The use of autologous carrier cells (cells obtained from the subject to be treated) can minimize innate and immune responses directed against the carrier cells, but can be onerous to the subject, expensive and limited in their availability. Allogeneic carrier cells, which can include a variety of readily isolable and/or commercially available cells/cell lines, offer the ease of availability and non-invasiveness to the subject; however, the greater magnitude of the innate and/or adaptive immune responses can compromise their therapeutic efficacy and clinical applicability.

The systems provided herein overcome or alleviate host immune responses by providing a head start on the therapeutic effects of the virus, i.e., through ex vivo viral replication and the expression of immunomodulatory and/or recombinantly expressed therapeutic protein(s) prior to administration, thereby permitting the use of allogeneic cells to generate the systems. The cells used in the systems provided herein also can be matched or optimized to be immunologically compatible or otherwise optimal in their therapeutic efficacy toward the particular subject being treated. Methods for matching cells with a virus and, further, with a subject are described in U.S. Provisional Patent Application No. 62/680,570, and U.S. application Ser. No. 16/536,073. The cells used in the systems provided herein also can be modified to overcome or alleviate immune host responses, as described in U.S. Provisional Patent Application No. 62/680,570 and U.S. application Ser. No. 16/536,073, and below. The modified cells also can be matched with a virus and/or a subject to be treated.

In some embodiments, the carrier cells used to generate the CAVES systems provided herein are not tumor cells. In other embodiments, the carrier cells are not cancer cells. In yet other embodiments, the carrier cells are not cancer cell lines, such as an immortalized cancer cell line. In embodiments, the carrier cells are selected from among, stromal cells, stem cells and fibroblasts.

Exemplary cells, e.g., carrier cells that can be used to generate the systems provided herein are described below.

Stem Cells, Immune Cells, Cancer Cell Lines

Stem cells, immune cells and tumor/cancerous cells can be used as delivery vehicles for oncolytic viruses (OVs), including HSV-1, parvovirus, measles virus, vesicular stomatitis virus (VSV), vaccinia virus, reovirus, New Castle Disease virus and adenovirus, among others. These cells demonstrate tumor-homing properties, which enhance the therapeutic effect of OVs. This tumor selectivity is due to the attraction of these cells to the tumor microenvironment, which is characterized by hypoxia, inflammation and an abundance of chemoattractant molecules, such as cytokines and chemokines.

Stem Cells

Stem cells possess an intrinsic tumor-homing ability, making them attractive as carrier cells for oncolytic virotherapy. This is due to the tumor microenvironment (TME), which is rich in various growth factors, angiogenic factors, cytokines and chemokines, which support the uncontrolled growth of tumors. The hypoxic nature of the TME also promotes the migration of stem cells towards tumors. Stem cells are used as carrier cells because they are highly immunosuppressive, and express lower levels of the molecules necessary for antigen processing and presentation, delaying the recognition of the viruses they harbor by the immune system (Kim et al. (2015) *Viruses* 7:6200-6217). Examples of stem cells that can be used as carrier cells for OVs include endothelial progenitor cells, neural stem cells and mesenchymal stem cells.

Endothelial progenitor cells have been shown to home to sites of tumor neovasculature and have been used to deliver oncolytic measles virus in a murine model of human glioma (Guo et al. (2008) *Biochim Biophys Acta* 1785 (2): 217-231). These cells divide rapidly in vivo, but are not immortal, and new cells must be repeatedly isolated from clinical samples (Kim et al. (2015) *Viruses* 7:6200-6217).

Neural stem cells (NSCs), which differentiate into various different cells of the nervous system, including neurons and glial cells, were the first stem cells investigated as carrier cells for the delivery of therapeutic agents to brain tumors (Kerrigan et al. (2017) *Cytotherapy* 19 (4): 445-457). NSCs display a strong tropism towards glioblastoma tumors, due to the hypoxia-inducible factor (HIF)-mediated expression of stromal cell-derived factor-1 (SDF-1), vascular endothelial growth factor (VEGF) and urokinase plasminogen activator (uPA) in glioma cells (Kim et al. (2015) *Viruses* 7:6200-6217). NSCs have been used in the delivery of IL-4, IL-12, IL-23, cytosine deaminase, the antiangiogenic protein thrombosponsin and OVs such as adenovirus to gliomas, for example. NSCs must be isolated from the brain tissues of fetuses or from the periventricular zone of adult brains during surgery, which is a disadvantage for their utility as carrier cells.

Adult human bone marrow has been used as an alternative source for stem cells, as bone marrow stem cells are easily acquired and can be sourced from the patients themselves for autologous transplant, precluding immune rejection (Kerrigan et al. (2017) *Cytotherapy* 19 (4): 445-457). Of the various bone marrow stem cells available, mesenchymal stem cells (MSCs) are attractive as carrier cells because they are easily isolated from patients and expanded in vitro, they support the replication of OVs and their protection from immediate neutralization by the immune system, they can be engineered easily and they inherently home to tumors in vivo due to the tumor-associated expression of inflammatory cytokines. MSCs can even be used as standalone anti-cancer agents. For example, studies have demonstrated the tumor-homing ability and oncolytic effects of MSCs expressing IFN-β (Nakashima et al. (2010) *Cytokine Growth Factor Rev.* 21 (2-3): 119-126).

MSCs express low levels of MHC class I molecules and do not express MHC class II molecules on their cell surfaces, allowing for allogeneic transplant. MSCs also can inhibit T-cell proliferation and differentiation of monocytes into dendritic cells (DCs), and can suppress the expression of interferon-gamma and tumor necrosis factor produced by CD4+T-helper cells (Kim et al. (2015) *Viruses* 7:6200-6217). MSCs also are capable of degrading the extracellular matrix via the secretion of proteases, which can help overcome the physical barriers to oncolytic viral delivery (Ramirez et al. (2015) *Oncolytic Virotherapy* 4:149-155). Another advantage to the use of MSCs is that they can be frozen after viral infection and, upon thawing, retain active viral replication and antitumor activity, allowing for their storage (Roy and Bell (2013) *Oncolytic Virotherapy* 2:47-56). In addition to bone marrow, MSCs also can be isolated from adipose tissue, umbilical cord blood, peripheral blood, muscle, cartilage and amniotic fluid, with adipose tissue being the most attractive source, due to the ease of access and abundance of adipose tissue (Kerrigan et al. (2017) *Cytotherapy* 19 (4): 445-457; Nakashima et al. (2010) *Cytokine Growth Factor Rev.* 21 (2-3): 119-126).

MSCs have served as carriers of oncolytic adenovirus for the treatment of pancreatic cancer, brain cancer, renal cell carcinoma, glioblastoma, and ovarian cancer, and as carriers of measles virus for the treatment of ovarian cancer and hepatocellular carcinoma (Kim et al. (2015) *Viruses* 7:6200-6217). For example, MSCs have been used as carriers of the oncolytic adenovirus ICOVIR-5 for the treatment of children with advanced metastatic neuroblastoma (Kerrigan et al. (2017) *Cytotherapy* 19 (4): 445-457; Ramirez et al. (2015) *Oncolytic Virotherapy* 4:149-155).

One downside to the use of MSCs, however, is their potential for promoting tumor growth, which has been demonstrated in models of breast cancer, endometrial tumors and glioma. In order to overcome this potential downfall, MSCs can be engineered to ensure their destruction upon delivery of the OV, for example, by carrying suicide genes (Kerrigan et al. (2017) *Cytotherapy* 19 (4): 445-457).

Examples of stem cells (autologous or allogeneic) that can be used as carrier cells include: adult stem cells; embryonic stem cells; fetal stem cells; neural stem cells; mesenchymal stem cells; totipotent stem cells; pluripotent stem cells; induced pluripotent stem cells; multipotent stem cells; oligopotent stem cells; unipotent stem cells; adipose stromal stem cells; endothelial stem cells (for example, endothelial progenitor cells, placental endothelial progenitor cells, angiogenic endothelial cells, pericytes); adult peripheral blood stem cells; myoblasts; small juvenile stem cells; skin fibroblast stem cells; tissue/tumor-associated fibroblasts; epithelial stem cells; and embryonic epithelial stem cells, for example.

Mesenchymal cells include, but are not limited to, for example, mesenchymal stem cells isolated/derived from: adult bone marrow, adipose tissue, blood, dental pulp, neonatal umbilical cord, umbilical cord blood, placenta, placenta-derived adherent stromal cells, placenta-derived decidual stromal cells, endometrial regenerative cells, placental bipotent endothelial/mesenchymal progenitor cells, amniotic membrane or fluid mesenchymal stem cells, amniotic fluid derived progenitors, Wharton's Jelly mesenchymal stem cells, pelvic girdle stem cells, Chorionic Villus Mesenchymal Stromal cells, subcutaneous white adipose mesenchymal stem cells, pericytes, adventitial reticular stem cells, hair follicle-derived stem cells, hematopoietic stem cells, periosteum-derived mesenchymal stem cells, lateral plate mesenchymal stem cells, exfoliated deciduous teeth stem cells, periodontal ligament stem cells, dental follicle progenitor cells, stem cells from apical papilla, muscle satellite cells and other such cells.

Cell Populations Derived from Adipose Stromal Vascular Fraction

In embodiments, the carrier cells used in the systems and methods provided herein are freshly isolated from adipose tissue stromal vascular fraction (SVF) and/or are SVF-derived cultured Adipose-Derived Mesenchymal Stromal/stem Cells (AD-MSC). Any of the oncolytic viruses known to those of skill in the art and provided herein can be combined with such cells to generate the CAVES systems provided herein and/or use them in the methods provided herein. In some embodiments, the oncolytic virus is a Vaccinia virus (VACV). In embodiments, the VACV is ACAM2000 having the sequence set forth in SEQ ID NO:70, or is a CAL1 virus having the sequence set forth in SEQ ID NO:71.

The ability of these carrier cells to protect, deliver and amplify the virus as well as to overcome innate and adaptive immune barriers was analyzed by flow cytometry, microscopy and virus plaque assays of ex vivo co-cultures of these cells infected with VACV in the presence of human serum or peripheral blood mononuclear cells from healthy donors. A comparative analysis was performed to establish statistically significant correlations and to evaluate the effect of stem cells on the activity of key immune cell populations. It was found that SVF cells can protect VACV against serum-inactivation. Cell sorting demonstrated that supra adventitial-adipose stromal cells (SA-ASC; CD235a −/CD45−/CD34+/CD146−/CD31−), and pericytes (CD235a−/CD45−/CD34−/CD146+/CD31−) are the primary populations of the SVF cells that are most efficient for delivering oncolytic virus to the tumor cells. This demonstrates, validating their clinical use as a tool to potentiate oncolytic virus therapies in autologous settings, and also in allogeneic settings.

Cultured AD-MSC (derived from CD34+SA-ASC) as a delivery vehicle is demonstrated herein to protect against serum-inactivation as well as to amplify the virus in the presence of human PBMCs in autologous and allogeneic settings. This can be linked to their intrinsic immunosuppressive properties and the evasion of allogeneic rejection. It is shown herein that these cells provide transient immunosuppression by inhibiting antiviral responses originating from both innate (NK)- and adaptive (T)-immune cells, thus augmenting viral oncolysis and the generation of anti-tumor immunity.

Provided herein are SA-ASCs and pericytes for use as carrier cells with an oncolytic virus known to those of skill in the art, including any described or provided herein. These include, but are not limited to, poxvirus, adenovirus, herpes simplex virus, Newcastle disease virus, vesicular stomatitis virus, mumps virus, influenza virus, measles virus, reovirus, human immunodeficiency virus (HIV), hanta virus, myxoma virus, cytomegalovirus (CMV) and lentivirus. Exemplary of the viruses is a vaccinia virus, such as, for example, ACAM1000, and ACAM2000, exemplary of which is the sequence set forth in SEQ ID NO:70, or CAL1, exemplary of which is the sequence set forth in SEQ ID NO:71, or minor variations (85%, 90%, 95%, 96% 97%, 98%, 99% or greater sequence identity in the genome excluding the ITRs, and possibly lower sequence identity by virtue of recombination of the ITRs during replication). The SA-ASCs (CD235a−/CD45−/CD34+/CD146−/CD31−), and pericytes (CD235a−/CD45−/CD34−/CD146+/CD31−), SA-ASCs and/or pericytes and/or the AD-MSC produced by culturing such cells, can be incubated together for a period of time that is sufficient for at least one immunomodulatory or recombinant therapeutic protein to be expressed by the oncolytic virus on the surface or inside the SA-ASC, pericytes or AD MSC carrier cells to produce the CAVES systems provided herein.

The sorting of cell populations from adipose SVF that promote viral infection and/or replication can be performed, for example, by incubating the SVF with an oncolytic virus, such as ACAM1000, ACAM2000 or CAL1, at a temperature suitable for such infection, such as room temperature (about 20° C.), or higher 32-42° C., e.g., 35-40° C., typically is 37° C. Loading of the virus into the cells at a suitable MOI, generally a low MOI, such as about 0.001-10, e.g., 0.01-1.0, or an MOI of 1.0 or less, can be performed, with continuous rotation, e.g., at 20 RPM, for about 20 minutes to about 5 hours, generally about 30 minutes to about 2 hours. In embodiments, the incubation is for about 1 hour. After the SVF cells or subpopulations or MSC produced therefrom are loaded with oncolytic virus, the cells can be labeled with a panel of antibodies against cell surface markers for different cell populations, e.g., CD235a, CD45, CD34, CD31 and CD146, and stained for viability with a suitable stain, such as propidium iodide (PI). The SVF cells can then be sorted by flow cytometry, based on the expression of the cell surface markers. In adipose SVF, seven distinct cell populations were identified and sorted: erythrocytes (CD235a+); supra adventitial-adipose stromal cells (SA-ASC; CD235a−/CD45−/CD34+/CD146−/CD31−), which are the main MSC precursors in culture; pericytes (CD235a−/CD45−/CD34−/CD 146+/CD31−), which also are MSC precursors in culture; granulocytes (CD235a−/CD 45 medium/high, side scatter (SSC) high); lymphocytes (CD235a−/CD45 high, SSC low); monocytes (CD235a−/CD45 high, SSC medium); and endothelial progenitors (CD235a−/CD45−/CD34+/CD146+/CD31+). The composition (%) of the main cell populations is described in Example 4.

To measure viral infection, the sorted individual cell populations from the SVF can then be seeded on suitable recipient cell monolayers, such as A549 tumor cell monolayers, and incubated for a period of time that permits plaque formation, for example, 1-5 days, for example, 1-3 days or 3 days or about 3 days. Plaque numbers formed in the cell monolayers can be measured by fixing and staining with a suitable stain, such as crystal violet, to determine the number of cells from each sorted population that are carrying the oncolytic virus. In adipose SVF, it was found that five different cell populations: erythrocytes, SA-ASC, pericytes, granulocytes and lymphocytes, were found to carry oncolytic virus, such as vaccinia virus, such as ACAM2000 or CAL1. The main cell populations from the 3 SVF fractions that carried the vaccinia virus (e.g., ACAM2000 or CAL1), were identified as SA-ASC (MSC precursors) and pericytes. These cell populations also can promote viral amplification.

Thus, also provided herein are erythrocytes, SA-ASC, pericytes, granulocytes and lymphocytes derived from SVF for use as carrier cells with an oncolytic virus. In embodiments, the oncolytic virus is Vaccinia virus (VACV). In further embodiments, the VACV is ACAM2000 having the sequence set forth in SEQ ID NO:70, or is a CAL1 virus having the sequence set forth in SEQ ID NO:71. In embodiments, the erythrocytes, SA-ASC, pericytes, granulocytes and lymphocytes can be incubated together for a period of time that is sufficient for at least one immunomodulatory or recombinant therapeutic protein to be expressed by the oncolytic virus on the surface or inside the SA-ASC or pericyte carrier cells, thereby generating the CAVES systems provided herein.

Immune Cells

Immune cells, which respond to "danger signals" released from tumors by trafficking to cancer sites, have been investigated as carrier cells for OVs. Immune cells include, but are not limited to, T cells, CAR-T cells targeting tumor-specific antigens, TCR transgenic cells targeting tumor-specific antigens; NKT cells, lymphocytes, monocytes, macrophages, mast cells, granulocytes, dendritic cells (DCs), natural killer (NK) cells, myeloid-derived suppressor cells, lymphokine-activated killer (LAK) cells, and cytokine-induced killer (CIK) cells, for example. Immune cells are attractive as carrier cells because they circulate systemically and can recognize tumors (Roy and Bell (2013) Oncolytic Virotherapy 2:47-56). The use of immune cells as carriers for OVs also provide additional antitumor activity in the form of direct cytotoxicity, or by priming adaptive antitumor immune responses (Jennings et al. (2014) Int. J. Cancer 134:1091-1101).

Tumor antigen-specific T cells, for example, display direct anticancer effector functions, and activated T cells have been extensively investigated in the delivery of OVs to tumors. It has been shown that loading adoptively transferred T cells with OVs can help combat the immunosuppressive nature of the tumor microenvironment, because the proinflammatory nature of viral infection can prevent the silencing and inactivation of T cells (Roy and Bell (2013) *Oncolytic Virotherapy* 2:47-56). The intratumoral expression of chemokines such as CCL3, CCL21 and CXCL10 (IP-10) enhances the tumor-specific trafficking of adoptive T cells. T cells also can be genetically engineered to express chemokine receptors such as CXCR2, in order to help direct them towards tumors (Guo et al. (2008) *Biochim Biophys Acta* 1785 (2): 217-231). Studies have demonstrated that vesicular stomatitis virus, reovirus, herpes simplex virus, Newcastle disease virus, and retrovirus particles can attach to the surface of T cells and be delivered to tumor cells either passively or via cellular synapses between the carrier and tumor cells (Roy and Bell (2013) *Oncolytic Virotherapy* 2:47-56). Despite the advantages of using T cells as carriers for OVs, it remains very expensive and difficult to raise T-cell populations against highly tumor-specific antigens from patients, limiting their use (Willmon et al. (2009) *Molecular Therapy* 17 (10): 1667-1676).

Lymphokine-activated killer cells (LAK cells) have been used in combination with IL-2 in the treatment of ovarian cancer. Immature dendritic cells (iDCs), LAK cells and their co-cultures (LAKDC) were tested as carriers for reovirus in the treatment for ovarian cancer, and it was shown that reovirus-loaded LAKDC were able to protect the reovirus from neutralizing antibodies, induce a proinflammatory cytokine milieu and generate an innate and adaptive antitumor immune response (Jennings et al. (2014) *Int. J. Cancer* 134:1091-1101). DC cells also have been used as carriers of reovirus for the treatment of melanoma (Jennings et al. (2014) *Int. J. Cancer* 134:1091-1101).

CIK cells are another type of immune cell that can be used as carriers for OVs. Whereas tumor antigen-specific T cells recognize one antigen, CIK cells recognize NKG2D ligands, which are often upregulated on a variety of tumor cells, making them more versatile. CIK cells also are easier to isolate from patients and expand ex vivo, can produce high titers of virus, and have been used to deliver measles and vaccinia viruses to tumors (Roy and Bell (2013) *Oncolytic Virotherapy* 2:47-56; Willmon et al. (2009) *Molecular*

*Therapy* 17 (10): 1667-1676; Power and Bell (2007) Mol. Ther. 15 (4): 660-665). One disadvantage to the use of CIK cells, however, is that their generation requires the expansion of primary leukocytes using cytokines in vivo (Kim et al. (2015) *Viruses* 7:6200-6217).

Macrophages represent yet another potential class of carrier cells for OVs. Since tumors often secrete monocyte chemotactic protein-1, macrophage colony-stimulating factor and VEGF, monocytes naturally migrate to tumor sites, localizing to hypoxic regions, and differentiating into tumor-associated macrophages, which can enhance tumor growth inhibition (Roy and Bell (2013) *Oncolytic Virotherapy* 2:47-56). As a result, macrophages have been investigated preclinically for the delivery of oncolytic adenovirus and measles virus. In addition to the other types of immune cells discussed, myeloid-derived suppressor cells also have been investigated as carrier cells for the delivery of oncolytic VSV.

Cancer Cells

Cancer cells, often inactivated with γ-irradiation before administration for safety, also have been used as carrier cells for OVs. The γ-irradiation can prevent tumorigenicity, but preserve viral production. Another safety measure involves the engineering of OVs to express suicide genes, such as thymidine kinase, to ensure that the cancer cells do not remain indefinitely in the subject (i.e., are killed and no longer immortal). Alternatively, allogeneic cancer cells, which typically are cleared by the recipients immune system, can be used (Power and Bell (2007) Mol. Ther. 15 (4): 660-665).

Cancer cells can be obtained in large amounts and display higher levels of viral infectivity and amplification than normal cells (Guo et al. (2010) *Gene Ther.* 17(12):1465-1475; Roy and Bell (2013) *Oncolytic Virotherapy* 2:47-56). Additionally, some tumor cells migrate specifically to certain organs, as is seen with metastatic disease. For example, myeloma cells express high levels of the chemokine receptor CXCR4, resulting in bone marrow metastases, and have been used in the delivery of oncolytic measles virus (Roy and Bell (2013) *Oncolytic Virotherapy* 2:47-56). A variety of transformed cell lines have been shown to deliver oncolytic parvovirus, measles virus, and vesicular stomatitis virus in immune-competent as well as immune-deficient animals. For example, carcinoma cells infected with VSV or adenovirus have been used to effectively deliver the virus to lung metastases in mice (Willmon et al. (2009) *Molecular Therapy* 17 (10): 1667-1676; Power and Bell (2007) *Mol. Ther.* 15 (4): 660-665). Cells derived from solid tumors, however, have been shown to accumulate in the lungs of mice following IV administration, due to their large diameters. As a result, cancer cells of hematopoietic/hematological origin can be a better alternative, as they are more widely distributed in the body and can deliver OVs to anatomical locations outside the lungs (Power and Bell (2007) *Mol. Ther.* 15(4):660-665).

Examples of allogeneic human hematological malignancy cell lines that can be used as carrier cells include: leukemia cells (such as, for example, KASUMI-1, HL-60, THP-1, K-562, RS4; 11, MOLT-4, CCRF-CEM, JVM-13, 31E9, ARH-77, MOB, JM1, NALM-1, ProPak-X.36); T cell leukemia cells (such as, for example, HM-2, CEM-CM3, Jurkat/Jurkat clone E6-1, J.CaM1.6, BCL2 Jurkat, BCL2 S87A Jurkat, BCL2 S70A Jurkat, Neo Jurkat, BCL2 AAA Jurkat, J.RT3-T3.5, J45.01, J.gammal, J.gammal. WT, JK28, P116, P116.cl39, A3, JX17, D1.1, 19.2, 1 2.1); myelomonocytic leukemia cells (for example, MV-4-11); lymphoma cells (for example, HT, BC-3, CA46, Raji, Daudi, GA-10-Clone-4, HH, H9); Non-Hodgkin's lymphoma cells (such as, for example, SU-DHL-1, SU-DHL-2, SU-DHL-4, SU-DHL-5, SU-DHL-6, SU-DHL-8, SU-DHL-10, SU-DHL-16, NU-DUL-1, NCEB-1, EJ-1, BCP-1, TUR, U-937); Burkitt Lymphoma cells (for example, Ramos/RA 1, Ramos.2G6.4C10, P3 HR-1, Daudi, ST486, Raji, CA46, Human gammaherpesvirus 4/HHV-4 cheek tumor from Burkitt Lymphoma Patient, DG-75, GA-10, NAMALWA, HS-Sultan, Jiyoye, NC-37, 20-B8, EB2, 1G2, EB1, EB3, 2B8, GA-10 clone 20, HKB-11/Kidney-B cell Hybrid); diffuse large B cell lymphoma cells (for example, Toledo, Pfeiffer); Mantle Cell Lymphoma cells (for example, JeKo-1, JMP-1, PF-1, JVM-2, REC-1, Z-138, Mino, MAVER-1); AML cells (for example, AML-193, BDCM, KG-1, KG-la, Kasumi-6, HL-60/S4); CML cells (for example, K562, K562-r, K562-s, LAMA84-r, LAMA84-s, AR230-r, AR230-s); ALL cells (for example, N6/ADR, RS4;11, NALM6 clone G5, Loucy, SUP-B15, CCRF-SB); erythroleukemia cells (for example, IDH2-mutant-TF-1 Isogenic cell line); myelomonoblastic leukemia cells (for example, GDM-1); malignant Non-Hodgkin's NK lymphoma cells (for example, NK-92, NK-92 MI); myeloma/plasmocytoma cells (for example, U266B1/U266, HAA1, SA13, RPMI8226, NCI-H929, MC/CAR); multiple myeloma cells (for example, MM.1R, IM-9, MM.1S); and macrophage cell lines (for example, MD, SC, WBC264-9C).

Commercial allogeneic cell lines include: mesenchymal stem cells, such as, for example, APCETH-201, APCETH-301 (APCETH), Cx601 (TIGENIX), TEMCELL, MSC-100-IV, Prochymal (MESOBLAST); induced pluripotent stem cells (iPSC), such as, for example, ToleraCyte (Fate Therapeutics); fibroblast cells, for example, CCD-16Lu, WI-38; tumor-associated fibroblasts, for example, Malme-3M, COLO 829, HT-144, Hs 895.T, hTERT PF179T CAF; endothelial cells, for example, HUVEC, HUVEC/TERT 2, TIME; embryonic epithelial cells, for example, HEK-293, HEK-293 STF, 293T/17, 293T/17 SF, HEK-293.2sus; embryonic stem cells, for example, hESC BG01V; and epithelial cells, for example, NuLi-1, ARPE-19, VK2/E6E7, Ect1/E6E7, RWPE-2, WPE-stem, End1/E6E7, WPMY-1, NL20, NL20-TA, WT 9-7, WPE1-NB26, WPE-int, RWPE2-W99, BEAS-2B.

Autologous or allogeneic whole tumor cell vaccines include GM-CSF secreting whole tumor cell vaccines (GVAX), such as, for example, GVAX Prostate (PC3/LN-CaP-based); GVAX Pancreas; GVAX Lung; and GVAX Renal Cell, from Cell Genesys/BioSante/Aduro Biotech.

Allogeneic human tumor cell lines include, for example, NCI-60 panel (BT549, HS 578T, MCF7, MDA-MB-231, MDA-MB-468, T-47D, SF268, SF295, SF539, SNB-19, SNB-75, U251, Colo205, HCC 2998, HCT-116, HCT-15, HT29, KM12, SW620, 786-O, A498, ACHN, CAKI, RXF 393, SN12C, TK-10, UO-31, CCRF-CEM, HL-60, K562, MOLT-4, RPMI-8226, SR, A549, EKVX, HOP-62, HOP-92, NCI-H226, NCI-H23, NCI-H322M, NCI-H460, NCI-H522, LOX IMVI, M14, MALME-3M, MDA-MB-435, SK-MEL-2, SK-MEL-28, SK-MEL-5, UACC-257, UACC-62, IGROV1, OVCAR-3, OVCAR-4, OVCAR-5, OVCAR-8, SK-OV-3, NCI-ADR-RES, DU145, PC-3). Other allogeneic human tumor cell lines include, for example, fibrosarcoma cell lines (HT-1080); hepatocarcinoma cell lines (Hih-7); prostate cancer cell lines (LAPC4, LAPC9, VCaP, LuCaP, MDA PCa 2a/2b, C4, C4-2, PTEN-CaP8, PTEN-P8); breast cancer cell lines (HCC1599, HCC1937, HCC1143, MDA-MB-468, HCC38, HCC70, HCC1806, HCC1187, DU4475, BT-549, Hs 578T, MDA-MB-231, MDA-MB-436, MDA-MB-157, MDA-MB-453, HCC1599, HCC1937, HCC1143, MDA-MB-468, HCC38, HCC70, HCC1806, HCC1187, DU4475, BT-549, Hs 578T, MDA-MB-231, MDA-MB-436, MDA-MB-157, MDA-MB-453, BT-20, HCC1395, MDA-MB-361, EMT6, T-47D, HCC1954); head and neck cancer cell lines (A-253, SCC-15, SCC-25, SCC-9, FaDu, Detroit 562); lung cancer cell lines (NCI-H2126, NCI-H1299, NCI-H1437, NCI-H1563, NCI-H1573, NCI-H1975, NCI-H661, Calu-3, NCI-H441); pancreatic cancer cell lines (Capan-2, Panc 10.05, CFPAC-1, HPAF-II, SW 1990, BxPC-3, AsPC-1, MIA PaCa-2, Hs 766T, Panc 05.04, PL45); ovarian cancer cell lines (PA-1, Caov-3, SW 626, SK-OV-3); bone cancer cell lines (HOS, A-673, SK-PN-DW, U-2 OS, Saos-2); colon cancer cell lines (SNU-C1, SK-CO-1, SW1116, SW948, T84, LS123, LoVo, SW837, SNU-C1, SW48, RKO, COLO 205, SW1417, LS411N, NCI-H508, HT-29, Caco-2, DLD-1); gastric cancer cell lines (KATOIII, NCI-N87, SNU-16, SNU-5, AGS, SNU-1); gynecological cancer cell lines (SK-LMS-1, HT-3, ME-180, Caov-3, SW626, MES-SA, SK-UT-1, KLE, AN3-CA, HeLa); sarcoma cell lines (SW684, HT-1080, SW982, RD, GCT, SW872, SJSA-1, MES-SA/MX2, MES-SA, SK-ES-1, SU-CCS-1, A-673, VA-ES-BJ, Hs 822.T, RD-ES, HS 132.T, Hs 737.T, Hs 863.T, Hs 127.T, Hs 324.T, Hs 821.T, Hs 706.T, Hs 707 (B).Ep, LL 86/LeSa, Hs 57.T, Hs 925.T, GCT, KHOS-312H, KHOS/NP R-970-5, SK-LMS-1, HOS); melanoma cell lines (SK-MEL-1, A375, G-361, SK-MEL-3, SH-4, SK-MEL-24, RPMI-7951, CHL-1, Hs 695T, A2058, VMM18, A375.S2, Hs 294T, VMM39, A375-P, VMM917, VMM5A, VMM15, VMM425, VMM17, VMM1, A375-MA1, A375-MA2, SK-MEL-5, Hs 852.T, LM-MEL-57, A101D, LM-MEL-41, LM-MEL-42, MeWo, LM-MEL-53, MDA-MB-435S, C32, SK-MEL-28, SK-MEL-2, MP38, MP41, C32TG, NM2C5, LM-MEL-1a, A7/M2A7); squamous cell carcinoma cell lines (SiHa, NCI-H520, SCC-15, NCI-H226, HCC1806, SCC-25, FaDu, SW 954, NCI-H2170, SCC-4, SW 900, NCI-H2286, NCI-H2066, SCC-9, *SCaBER*, SW579, SK-MES-1, 2A3, UPCI: SCC090, UPCI: SCC152, CAL 27, RPMI 2650, UPCI: SCC154, SW756, NCI-H1703, ME-180, SW962); hepatocellular carcinoma cell lines (Hep G2, Hep 3B2.1-7/Hep 3B, C3A, Hep G2/2.2.1, SNU-449, SNU-398, SNU-475, SNU-387, SNU-182, SNU-423, PLC/PRF/5); bladder cancer cell lines (5637, HT-1197, HT-1376, RT4, SW780, T-24, TCCSUP, UM-UC-3); renal cell carcinoma cell lines (ACHN, 786-0/786-0, 769-P, A-498, Hs 891.T, Caki-2, Caki-1); embryonal carcinoma/testicular teratoma cell lines (NTERA-2 c1.D1, NCCIT, Tera-2, Tera-1, Cates-1B); glioblastoma cell lines (LN-229, U-87 MG, T98G, LN-18, U-118 MG, M059K, M059J, U-138 MG, A-172); astrocytoma cell lines (SW 1088, CCF-STTG1, SW 1783, CHLA-03-AA); brain cancer cell lines (PFSK-1, Daoy); thyroid carcinoma cell lines (TT, MDA-T68, MDA-T32, MDA-T120, MDA-T85, MDA-T41) and mesothelioma cell lines (NCI-H28, NCI-H226, NCI-H2452, NCI-H2052, MSTO-211H).

Matched Cells

Any of the cells used in the systems provided herein, such as those described above, can be tested for their matching compatibility with a virus and/or a subject to whom virotherapy is to be administered, i.e., the ability of the cell to overcome or ameliorate innate and/or adaptive immune responses directed against the cell and/or the associated virus. The selection of cells that are matched to a subject can further increase the therapeutic efficacy of the systems provided herein. Methods of screening for optimal cell-virus combinations (e.g., the ability of a cell to promote viral amplification) and cells that are matched to a subject are described in U.S. Provisional Patent Application No. 62/680,570, and U.S. application Ser. No. 16/536,073. Also provided herein are modified cell vehicles that are sensitized and/or engineered in one or more ways for improved cell delivery (see, e.g., Section below).

Modified Cell Vehicles with Improved Delivery and/or Matching Capabilities

Also provided herein are cell vehicles (carrier cells) whose properties are modified to facilitate delivery of an oncolytic virus to a subject and/or provide improved matching with a subject. Any of the cell vehicles provided herein (e.g., stem cells, immune cells, cancer cells) can be so modified. Such properties can include, but are not limited to, improved facilitation of viral amplification in the cell delivery vehicle, an improved ability to evade immune responses directed against the cell vehicle and/or the virus and/or improved immunosuppression. In embodiments, the immunomodulatory capabilities (e.g., evading immune responses, suppressing immune responses) can be local and/or transient, being present to the extent needed to facilitate delivery, accumulation and infection of the virus in the tumor or other cancerous cells.

In some embodiments, a modified cell vehicle provided herein can be screened using matching assays as described in U.S. Provisional Patent Application No. 62/680,570 and U.S. application Ser. No. 16/536,073, to ascertain its suitability as a cell vehicle for delivery of an oncolytic virus to a particular subject and/or a particular cancer/tumor type. In embodiments, a plurality/panel of modified cell vehicles can be screened by the matching assays described in U.S. Provisional Patent Application No. 62/680,570, and U.S. application Ser. No. 16/536,073, and ranked in order of their matching capability. In some examples, the panel of cell vehicles can include unmodified cell vehicles.

Briefly, methods of matching carrier cells to a subject, as described in U.S. Provisional Patent Application No. 62/680,570, and U.S. application Ser. No. 16/536,073, include performing one or more of the following steps:

1. determining whether the cell vehicle overcomes immune barriers in the subject by detecting, in a co-culture containing the cell vehicle, the oncolytic virus and cells from the subject, one or more of:
   - (a) a reduced level of one or more markers for T cell activation compared to otherwise equivalent conditions except the cell vehicle is not present;
   - (b) a reduced level of one or more markers for NK cell activation compared to otherwise equivalent conditions except the cell vehicle is not present; and
   - (c) a reduced level of one or more markers for NKT cell activation compared to otherwise equivalent conditions except the cell vehicle is not present, where if one or more of (a), (b) and (c) is/are satisfied, the cell vehicle is a match for the subject.

2. (a) measuring the amount of viral amplification obtained when the virus and the cell vehicle are incubated together with cells from the subject;
   - (b) measuring the amount of viral amplification obtained when the virus and the cell vehicle are incubated under equivalent conditions, except in the absence of cells from the subject; and
   - (c) comparing the amounts measured in (a) and (b), where if the amount of amplification measured in (a) is at least 20% of the amount of amplification measured in (b), the cell vehicle is a match for the subject.

3. identifying identical alleles in the cell vehicle and the subject at one or more major histocompatibility complex (MHC) and/or killer cell inhibitory receptor (KIR) genetic loci and if, e.g., 50% or more of the alleles are identical, identifying the cell vehicle as a match for the subject.

The modified cell vehicles provided herein can contain one or more of the modifications set forth in this section and elsewhere herein, as described:

(i) Sensitized/Protected Cell Vehicles for Improved Viral Amplification and/or Immunomodulation Modified cell vehicles (carrier cells) for generating the CAVES systems provided herein, and for use in the methods provided herein, can include one or more of the following embodiments. In embodiments, the cell vehicles can be sensitized to enhance their virus amplification ability by pre-treating/loading the cell vehicles with one or more of: IL-10, TGFβ, VEGF, FGF-2, PDGF, HGF, IL-6, GM-CSF, Growth factors, RTK/mTOR agonists, wnt protein ligands and GSK3 inhibitors/antagonists (e.g., Tideglusib, Valproic acid). In other embodiments, the cell vehicles can be sensitized to block induction of the anti-viral state, for example, by pre-treating/loading the cell vehicles with small molecule or protein inhibitors that interfere with IFN Type I/Type II receptors and/or interfere with downstream signaling including, but not limited to, IFNAR1/IFNAR2 signaling, IFNGR1/IFNGR2 signaling, STAT1/2 signaling, Jak1 signaling (e.g., Tofacitinib, Ruxolitinib, Baricitinib), Jak2 signaling (e.g., SAR302503, LY2784544, CYT387, NS-018, BMS-911543, AT9283), IRF3 signaling, IRF7 signaling, IRF9 signaling, TYK2 signaling (e.g., BMS-986165), and TBK1 signaling (e.g., BX795, CYT387, AZ13102909).

In some embodiments, the cell vehicles can be pre-treated/loaded with HDAC inhibitors for interfering with/deregulating IFN signaling/responsiveness; such inhibitors can include, but are not limited to, Vorinostat, Romidepsin, Chidamide, Panobinostat, Belinostat, Valporic acid, Mocetinostat, Abexinostat, Entinostat, SB939, Resminostat, Givinostat, Quisinostat, HBI-8000, Kevetrin, CUDC-101, AR-42, CHR-2845, CHR-3996, 4SC-202, CG200745, ACY-1215, ME-344, Sulforaphane and/or Trichostatin. In other embodiments, the cell vehicles can be pre-treated/loaded with antagonists of virus sensing and/or anti-virus defense pathways mediated by STING, PKR, RIG-1, MDA-5, OAS-1/2/3, AIM2, MAVS, RIP-1/3, DAI (ZBP1); such antagonists can include, but are not limited to, one or more of K1, E3L, K3L proteins (Vaccinia), NS1/NS2 proteins (Influenza), NS3-4A (Hepatitis C), NP and Z proteins (Arenavirus), VP35 (Ebola virus), US11, ICP34.5, ICPO (HSV), M45 (MCMV) and X protein (BDV: Borna Disease Virus). In embodiments, the cell vehicles can be protected against allogeneic inactivation/rejection determinants, such as by pre-treating/loading the cells with MHC antagonists of viral origin, e.g., one or more of A40R MHCI antagonist (Vaccinia), Nef and TAT (HIV), E3-19K (Adenovirus), ICP47 (HSV-1/2), CPXV012 and CPXV203 (Cowpox), ORF66 (VZV), EBNA1, BNLF2a, BGLF5, BILF1 (EBV), US2/gp24, US3/gp23, US6/gp21, US10, US11/gp33 (hCMV), Rh178/VIHCE (RhCMV), U21 (HHV-6/7), LANA1, ORF37/SOX, kK3/MIR1, kK5/MIR2 (KSHV), mK3 (MHV-68), UL41/vhs (a-herpesvirus, HSV, BHV-1, PRV), UL49.5 (Varicellovirus, BHV-1, EHV-1/4, PRV) and m4/gp34, m6/gp48, m27, m152/gp40 (mCMV).

In embodiments, the modified cell vehicles can be pre-treated/loaded with B2M antagonists of viral origin, e.g., UL18 (HCMV). In other embodiments, the cell vehicles can be pre-treated/loaded with antagonists of MIC-A and MIC-B (NKG2D ligands), e.g., kK5 (KHSV). In some embodiments, the cell vehicles can be pre-treated/loaded with one or more immunosuppressing factors of viral origin including, but not limited to, inhibitors of immune FAS/TNF/Granzyme B-induced apoptosis (e.g., Ectromelia/Vaccinia virus SP1-2/CrmA), IL-1/NFKB/IRF3 antagonists (e.g., Vaccinia virus-encoded N1), IL-1 and TLR antagonists (e.g., IL-18 binding protein, A46R, A52R), IL-1B antagonists (e.g., B15R/B16R), TNFα blockers (e.g., Vaccinia virus CmrC/CmrE), IFNa/β blockers (e.g., Vaccinia virus B18R/B19R) and IFNY blockers (e.g., Vaccinia virus B8R). In embodiments, the cell vehicles can be pre-treated/loaded with small molecule inhibitors of TAP1/2 and/or tapasin.

In embodiments, the modified cell vehicles can be protected against complement by, e.g., pre-treating/loading the cell vehicles with small molecule inhibitors of complement factors (e.g., C1, C2, C3, C4, C5, MBL); such inhibitors can include, but are not limited to, one or more of VCP (Vaccinia virus complement control protein), B5R (Vaccinia virus complement inhibitor), scFv anti-CD1q/CD1r/CD1s, anti-C3, anti-C5 (e.g., Eculizumab), peptidic C3 inhibitors of the compstatin family (e.g., Cp40), Human soluble membrane (s/m) proteins (e.g., s/mCR1 (CD35), s/mCR2 (CD21), s/mCD55, s/mCD59), Human Factor H and derivatives, Cobra venom factors and derivatives with complement inhibitory activity.

In the above embodiments, instead of loading or treating the cell with these factors, the viruses can be modified to express these products, or, by virtue of the methods herein, the viruses express these products in the carrier cell when incubated with the carrier cell.

The sensitized cell vehicles can be generated by methods known in the art. For example, the cell vehicles can be pre-treated with the sensitizing agents, e.g., proteins or small molecule agonists/antagonists by incubation for between 10 minutes to 48 or more hours prior to cell banking, virus infection or administration to the subject, e.g., about or at least for 10, 15, 20, 25, 30, 35, 40, 45, 50, 55 or 60 minutes or about or at least 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 or more hours prior to cell banking, virus infection or administration to subject. To enhance the loading of proteins/lipid insoluble small molecules into the cells, lipofectamine or alternative protein transfection reagents can be used, such as, for example, Xfect (Takara), Pierce Pro-Ject (ThermoFisher), Pro-DeliverIN (OZ Biosciences), TurboFect (Fermentas), or alternative.

(ii) Sensitized for Resistance to Virus-Mediated Killing (for Extended Survival and Improved Local Immunosuppression)

The modified cell vehicles can, in some embodiments, be pre-treated/loaded with one or more agents that render the cell vehicles resistant to virus-mediated killing. For example, in some embodiments, the cell vehicles can be pretreated with Type I and/or Type II interferons. In other embodiments, the cell vehicles can be pretreated with agonists/inducers of anti-viral state (e.g., STING, PKR, RIG-I, MDA-5). To generate such "protected" cell vehicles, any autologous or allogeneic cell vehicles can be treated with Interferon Type I (e.g., IFNα/β) and/or Type II (e.g., IFNγ) and/or agonists of STING, PKR, RIG-I, MDA-5, OAS-1/2/3, AIM-2, MAVS, RIP-1/3, DAI (ZBP1) pathways for between 30 minutes to up to 48 or more hours, e.g., about or at least 30 minutes or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 or more hours without or prior to virus infection.

These "protected" cell vehicles can be administered as a separate composition concurrently with a matched/sensitized/engineered cell vehicle that is not so protected and includes the virus; the protected cell vehicles can provide extended survival and/or improved local immunosuppression. In some embodiments, the protected cell vehicles can be administered within, for example, about or at least 10, 15, 20, 24, 25, 26, 27, 28, 29, 30, 31, 32, 33, 34, 35, 36, 37, 38, 39, 40, 41, 42, 43, 44, 45, 46, 47 or 48 hours or 1, 2, 3, 4 or 5 days prior to or after administering the matched/sensitized/engineered cell vehicle that is not so protected and includes the virus.

(iii) Engineered Cell Vehicles for Improved Viral Amplification and/or Immunomodulation In some embodiments, the modified cell vehicles for use in the systems and methods provided herein are engineered for transient or permanent expression or suppression of genes to facilitate improved viral amplification and/or immunomodulation. The cell vehicles can be engineered in one or more of the following embodiments. Any of the cell vehicles provided herein can be modified using one or a combination of the embodiments for sensitizing, protecting and/or engineering the cell vehicles as provided herein.

In some embodiments, the cell vehicles can be engineered to be unresponsive to an interferon (IFN)-induced antiviral state. For example, the cell vehicles can be engineered for transient or permanent (excising the gene locus, e.g.) suppression of IFN Type I/Type II receptors and/or downstream signaling such as, for example, suppression of one or more of Type I/Type II interferon receptor expression; IFN α/β, IFNγ receptor expression; IFNAR1/IFNAR2 receptor expression; IFNGR1/IFNGR2 receptor expression; STAT1/2 receptor expression; Jak1/2 receptor expression; IRF3 receptor expression; IRF7 receptor expression; IRF9 receptor expression; TYK2 kinase expression and TBK1 kinase expression.

In embodiments, the cell vehicles can be engineered for transient or permanent suppression of elements of the cytosolic viral DNA/RNA-sensing and anti-viral defense machinery including, but not limited to, one or more of PKR, RIG-I, MDA-5, cGAS, STING, TBK1, IRF3, OAS-1/2/3, AIM2, MAVS, RIP-1/3 and DAI (ZBP1). In other embodiments, the cell vehicle can be engineered for transient or permanent expression of antagonists of virus-sensing and anti-viral defense pathways mediated by, e.g., STING, PKR, RIG-1, MDA-5, OAS-1/2/3, AIM2, MAVS, RIP-1/3, DAI (ZBP1); these can include, but are not limited to, one or more of K1, E3L, K3L (Vaccinia); NS1/NS2 (Influenza A); NS3-4A (Hepatitis C); NP, Z protein (Arenavirus); VP35 (Ebola virus); US11, ICP34.5, ICPO (HSV); M45 (MCMV); and X protein (BDV: Borna Disease Virus).

In some embodiments, the modified cell vehicles can be engineered to evade allogeneic recognition by T and NKT cells. For example, the cell vehicles can be engineered for transient or permanent suppression of expression of: MHC Class I molecules (HLA-A, B, C); MHC Class II molecules (HLA-DP, DQ, DR); MHC-like molecules (CD1a/b/c/d); or regulators of transcription or expression of MHC Class I, MHC Class II, MHC-like molecules (e.g., TAP1/2, Tapasin, Beta-2 microglobulin, CIITA, RFXANK, RFX5 and RFXAP). In other examples, the cell vehicles can be engineered for transient or permanent expression of: B2M Antagonists of Viral Origin (e.g., UL18 (HCMV)); and/or MHC Antagonists of Viral Origin (e.g., one or more of A40R MHCI (Vaccinia); Nef, TAT (HIV); E3-19K (Adenovirus); ICP47 (HSV-1/2); CPXV012, CPXV203 (Cowpox); EBNA1, BNLF2a, BGLF5, BILF1 (EBV); ORF66 (VZV); US2/gp24, US3/gp23, US6/gp21, US10, US11/gp33 (hCMV); rh178/VIHCE (RhCMV); U21 (HHV-6/7); LANA1, ORF37/SOX, kK3/MIR1, kK5/MIR2 (KHSV); mK3 (MHV-68); UL41/vhs (a-herpesvirus, HSV, BHV-1, PRV); UL49.5 (Varicellovirus, BHV-1, EHV-1/4, PRV); and m4/gp34, m6/gp48, m27, m152/gp40 (mCMV)).

In embodiments, the cell vehicles can be engineered to evade allogeneic recognition by NK Cells. For example, the cell vehicles can be engineered for transient or permanent suppression of expression of one or more of: Membrane-Bound MICA/B (NKG2D Ligands); Membrane-Bound PVR (DNAM-1 Ligand); and Membrane-Bound Nectin-2 (DNAM-1 Ligand). In other examples, the cell vehicles can be engineered for transient or permanent expression of: antagonists of MIC-A and MIC-B (NKG2D ligands) (e.g., kK5 (KHSV)); antagonists of the NKG2D receptor (e.g., Cowpox OMCP); antagonists of NCR-targeting NKp30, NKp44, NKp46 receptors (e.g., HA (hemagglutinin—in vaccinia and other viruses)); ligands for the NK inhibitory receptors (KIR) (e.g., HLA-Bw4; HLA-C2); and ligands for the NK inhibitory receptors (NKG2a/CD94) (e.g., HLA-E and derivatives alone or combined with 21M HLA-B ligands to generate HLA-E binding peptides and stabilize HLA-E surface expression).

In certain embodiments, the cell vehicles can be engineered to express immunosuppressive factors of human or viral origin (e.g., to prevent/inhibit allogeneic anti-cell vehicle or anti-viral immune responses). This can be accomplished by encoding them in the cell genome and/or the viral genome. Factors of human origin include, but are not limited to, IDO, Arginase, TRAIL, iNOS, IL-10, TGFβ, VEGF, FGF-2, PDGF, HGF, IL-6, sMICA, SMICB, sHLA-G, HLA-E, PD-L1, FAS-L, B7-H4 and single-chain antibodies (scFv) that target or deplete NK and/or NKT cells. Factors of viral origin include, but are not limited to, Ectromelia/Vaccinia virus SPI-2/CrmA (inhibitor of immune FAS/TNF/Granzyme B induced apoptosis); Vaccinia Virus encoded N1 (IL-1/NFkB/IRF3 antagonist); HA (NCR antagonists targeting NKp30, NKp44, NKp46); IL-18 binding protein; A40R; A46R; A52R; B15R/β16R; TNFα blockers (e.g., Vaccinia virus CmrC/CmrE); IFN α/β blockers (e.g., Vaccinia virus B18R/β19R); IFNγ blockers (e.g., Vaccinia virus B8R) and other IL-1/IL-1B/NFkB/IRF3/NCR/MHCI/TLR/NKG2D antagonists.

In some embodiments, the cell vehicles can be engineered to express cancer or stem cell-derived factors that facilitate viral infection of otherwise impermissive cell vehicles and/or tumor cells. For example, the cell vehicles can be engineered to express one or more of: cancer associated antigens (e.g., cancer testis antigens (MAGE-A1, MAGE-A3, MAGE-A4, NY-ESO-1, PRAME, CT83, SSX2, BAGE family, CAGE family); oncofetal antigens (AFP, CEA); oncogene/tumor suppressors (myc, Rb, Ras, p53, Telomerase); differentiation antigens (MELAN, Tyrosinase, TRP-1/2, gp100, CA-125, MUC-1, ETA); GM-CSF; IL-10; TGFβ; VEGF; FGF-2; PDGF; HGF; IL-6; growth factors; RTK/mTOR agonists and wnt protein ligands.

In embodiments, the modified cell vehicles can be engineered to express factors that interfere with the function of complement and/or neutralizing antibodies, including, but not limited to, one or more of: protein Antagonists of complement factors (C1, C2, C3, C4, C5, MBL); Vaccinia virus complement control protein (VCP); Vaccinia virus complement inhibitor (B5R); scFv anti-CD1q/CD1r/CD1s; anti-C3; anti-C5 (e.g., Eculizumab); peptidic C3 inhibitors of the compstatin family (e.g., Cp40); human soluble membrane (s/m) proteins (e.g., s/mCR1 (CD35), s/mCR2 (CD21), s/mCD55, s/mCD59); Human Factor H and derivatives and cobra venom factors and derivatives with complement inhibitory activity.

(iv) Engineered Cell Vehicles to Express Angiogenesis Inhibitors for Vascular Normalization/Tumor Blood Vessels Reprogramming In some embodiments, the cell vehicles can be engineered to encode angiogenesis inhibitors (for tumor blood vessels reprogramming/repairing, stabilizing and/or normalizing the tumor vasculature, e.g.). Details of such inhibitors are described below in part "2. Viruses," where such modifications of the viruses that are a component of the CAVES provided herein are described. As described below, angiogenesis inhibitors can induce vascular normalization, repairing tumor vasculature (tumor blood vessel reprogramming) by restoring balance in the cascade of signals initiated by the interplay of tumor cells with their local cellular environment. This in turn can lead to enhanced tumor perfusion and reduction of hypoxia within the tumor, which in turn can result in improved reduction in primary tumor growth, ascites and metastases.

The CAVES compositions and related methods of use and treatment provided herein can include cell vehicles that encode molecules that inhibit angiogenesis, including those that downregulate pro-angiogenic factors and/or upregulate anti-angigenic factors. Alternately, or, in addition, the CAVES compositions provided herein can be administered in combination with angiogenesis inhibitors and/or with viruses that encode angiogenesis inhibitors.

(v) Engineered Cell Vehicles to Express Transgenes for Conditional Cell Immortalization In some embodiments, the cell vehicles for the CAVES compositions and related methods provided herein can be engineered to encode transgenes for conditional cell immortalization (see, e.g., review by Wall et al., *Cell Gene Therapy Insights,* 2 (3): 339-355 (2016) and references cited therein, the contents of which are incorporated in their entirety by reference herein). Conditional immortalization uses inducible transgene technology to create cells that can be expanded to clinical quantities in a stable, consistent fashion to obtain target cells of interest when the transgene is active, e.g., under the control of an operator, yet be deactivable when needed so they are returned to a normal, post-mitotic state. This permits safe delivery of a consistently reproducible, stable, scalable cell formulation (e.g., CAVES) to a subject in need of treatment, while minimizing or eliminating the risk of cancer from administering constitutively immortalized cells. The ability to obtain high numbers of cell vehicles of consistent quality in a way that is scalable and cost-effective, yet safe for administration to a subject, is desirable, e.g., for developing "off-the-shelf" allogeneic cells for clinical use in cell-based compositions, such as the CAVES provided herein.

Conditional immortalization of cells can be performed using methods known to those of skill in the art and can vary, e.g., depending on the type of cell and species from which it is obtained. For example, stress activation of the p53 and pRB pathways are common causes of senescence in mice; growing mouse cells under optimal media and oxygen conditions can inhibit or silence these genes, thereby alleviating the stress. Human cells, on the other hand, in addition to silencing of p53 and pRB genes, also require telomere maintenance via, e.g., telomerase reconstitution. Exemplary genes that can controllably (conditionally) be activated/deactivated for cell division include, for example, oncogenes and telomerases. Exemplary technologies for conditional immortalization include, but are not limited to, the following:

E6/E7

Oncoproteins from the human papilloma virus type 16 (HPV16), E6 and E7, cooperate in mediating cellular immortalization by inactivating tumor suppressors such as p53 and pRB. Thus, conditional immortalization can be achieved by conditional inactivation of these tumor suppressors when expansion is desired, followed by their activation when expansion is to be stopped (e.g., prior to administration as a therapy; see, e.g., Storey et al., *Oncogene,* 11:653-661 (1995)).

Myc Gene

The c-myc gene, along with its viral homolog v-myc, exerts regulatory control over a range of cell functions. In particular, it drives cell cycle entry and cell division, which makes it an attractive target for creating stable immortalized cell lines. Mutations in the myc gene that result in it being constitutively expressed are associated with oncogenic transformation, resulting in cancer. Therefore, controlled expression of c-myc, preferably under control of an operator, is desired for conditional immortalization.

The conditional immortalization technology c-MycER-$^{TAM}$ is a fusion gene that encodes a chimeric protein containing c-myc and an N-terminal truncated hormone binding domain of a mutant murine estrogen receptor (G525R). The mutant G525R no longer can bind to 17 β-estradiol and estrogen but is responsive to activation in the presence of the synthetic estrogen-like agonist, 4-hydroxytamoxifen (4-OHT). Thus, culturing cells in the presence of 4-OHT promotes c-myc activity and subsequent cell division, whereas in the absence of 4-OHT, the cells revert to a non-activated state and can undergo maturation/differentiation as normal cells do.

The synthesis of c-MycER$^{TAM}$ does not affect the phenotype of the cells, and this conditional immortalization technology has been used for the development of human stem cell lines from cortical neuroepithelium, which have been investigated in pre-clinical animal studies for ischemic stroke, limb ischemia, and are currently being investigated in clinical trials as a treatment for stroke disability (Phase 1 and 2) and in Phase 1 trial for clinical limb ischemia.

Among the myc oncogenes, the avian viral homolog v-myc also has proven to effectively immortalize human neural stem cells (hNSCs). The p110gag-myc protein encoded in the avian myelocytomatosis virus genome is spontaneously downregulated after differentiation. Like its cellular counterpart, v-myc transduced hNSC growth and differentiation are dependent on mitogenic stimulation by growth factors. Spontaneous downregulation of the avian v-myc after 24-48 hours of engraftment in neonatal mice was observed, indicating their promise as conditionally immortalized cell vehicles. Established v-myc hNSC cell lines have shown potential as delivery vehicles for selective gene therapy due to their tumor-tropic properties. Preclinical studies of a hNSC line (HB1.F3.CD) genetically modified to express cytosine deaminase, resulted in tumor site conversion of 5-fluorocytosine to the chemotherapeutic 5-fluorouracil. Currently, a Phase 1 clinical trial is underway to study dosages and side effects of this anti-cancer strategy (ID: 13401 NCI-2013-02346 13401).

Temperature Sensitive Simian Virus sV40 T Antigen

SV40 is a double-stranded DNA virus of rhesus monkey origin. SV40 has a number of antigens, among which is the large tumor antigen (Tag). Tag regulates cell signaling pathways that induce cells to enter into S phase and undergo a DNA damage response that facilitates viral DNA replication. Tag also binds to and inactivates the p53 and pRB family of proteins, powerful tumor suppressors involved in cell cycle progression and apoptosis, to create an ideal environment permissive for viral replication. Early work with rodent cells showed that Tag immortalized these cells such that they acquired infinite proliferative potential. Subsequent inactivation of Tag resulted in rapid and irreversible loss of proliferative potential in G1 and G2 phases of the cell cycle, demonstrating that Tag is continuously required to maintain the proliferative state. These traits made Tag an ideal candidate for developing controllable cell lines.

Inactivation of Tag was achieved using a temperature-sensitive mutant of the large Tag (SV40 tsA58) that had originally been isolated in 1975 and found to behave as wild type at the permissive temperature (33.5° C.) but was biologically inactive at the non-permissive temperature of 39° C. Therefore, conditional immortalization can be achieved by expanding the cells at the permissive temperature, then facilitating differentiation by increasing the temperature of the cells to the non-permissive temperature. Preclinical studies by ReNeuron Ltd. (UK)/University College London are being performed for the treatment of retinitis pigmentosa, using a human fetal retinal cell line (hRPC) conditionally immortalized using the SV40 large tumor antigen.

Telomerase

In human somatic cells, the progressive shortening of telomeres, short repetitive sequences at the ends of chromosomes, with each cell division has been proposed to be the mitotic clock. Human telomeres contain multiple tandem repeats of TTTAGG located at the ends of the chromosome. They are dependent on the enzyme telomerase to maintain their length, but because human somatic cells do not express telomerase at levels sufficient to maintain the telomeres, they shorten by around 50 base pairs at each cell division. Collectively, telomere loss in conjunction with the lack of telomerase activity is the mitotic clock responsible for limiting the number of divisions before senescence.

The catalytic subunit of human telomerase reverse transcriptase, hTERT, catalyzes the synthesis of the 6 bp repeats to elongate telomeres. Because basal levels of telomerase in primary human cells are not enough for an unlimited lifespan, the transduction of exogenous hTERT can result in extending lifespan.

Although it originally was proposed that reconstitution of telomerase activity using hTERT was sufficient for the immortalization of primary human cells, it was found that sometimes reconstitution of telomerase alone was insufficient; in these instances, secondary inactivation of regulator pathways such as p16 and pRB was required.

While the above studies assessed constitutive activation, telomerase has, in combination with other conditional transgenes, proven successful in supporting conditional immortality (O'Hare et al., *Proc. Natl Acad. Sci. USA,* 98 (2): 646-651 (2001)). For example, the U19 Tag mutant of SV40 is defective for binding the SV40 origin of replication and when delivered in a recombinant retrovirus encoding a U19 Tag, was more efficient at immortalizing rodent cells than wild-type Tag. A vector incorporating both tsA58 (temperature sensitive Tag mutation, see description above) and U19 mutations was constructed to create a murine oligodendrocyte precursor cell line capable of in vitro differentiation (Almazan et al., *Brain Res.,* 579:234-245 (1992)). The U19tsA58 Tag was found to be capable of creating a conditionally immortal cell line from rat neonatal optic nerve that could differentiate into oligodendrocytes (Barnett et al., *Eur. J. Neurosci.,* 5:1247-1260 (1993)). The U19tsA58 Tag also was used to study the heterogeneity of candidate regenerative olfactory ensheathing cells from olfactory bulb and lamina propria (Franceschini et al., *Dev. Biol.,* 173 (27): 327-343 (1996)). Studies by O'Hare et al. showed that ectopic expression of hTERT or U19tsA58 Tag alone was insufficient for immortalization of freshly isolated human cells, but a combination of the genes resulted in efficient generation of immortal cells lines irrespective of the order in which they were introduced (O'Hare et al., *Proc. Natl Acad. Sci. USA,* 98 (2): 646-651 (2001)).

Cre-loxP System

Bacteriophage p1 Cre is an enzyme that promotes recombination in specific sites called loxP. When two 33 bp loxP sequences are oriented, recombination occurs and consequently the intervening sequence is cleaved and removed. The application of reversible immortalization by Cre-loxP is promising for both autologous and allogeneic cell therapy. Biopsies and primary cultures can be immortalized with a recombinant oncogene flanked with loxP sites. Transfection with Cre will then result in the excision of the immortalizing genes. After oncogene removal, the cells should be identical to the primary culture population, but in increased numbers.

The Cre-loxP system has been applied from rat adrenal cells to human hepatocytes and myogenic cells with hTERT and Tag as immortalizing genes (see discussion above). To eliminate any cells that may not have deleted the transgene, negative controls for recombination have included a Herpes simplex virus 1-thymidine kinase (HSV-TK) suicide gene in order to kill the small portion of refractory immortalized cells in the presence of ganciclovir (GCV), after Cre transfection. Tamoxifen-dependent Cre recombinases also have been incorporated in order to achieve controlled excision of the oncogene.

Tet-On and Tet-Off

Conditional immortalization also has been achieved by the use of transcription-regulated systems. The most widely used have been derived using the prokaryotic tetracycline repression system. They utilize a tet repressor (tetR) protein that binds to a sequence called the tetracycline operator (tetO) in the absence of the antibiotic (tetracycline or doxycycline). When the antibiotic is present, it binds to the repressor, thereby inhibiting it's binding to the tetO.

The first system available for conditional immortalization was called "Tet-Off," which was developed in HeLa cells. In this system, the tet repressor binding site is inserted between the promoter and the transcriptional start site such that binding of the repressor sterically blocks transcription. However, the steric hindrance is overcome upon addition of small amounts of tetracycline and doxycycline that prevent binding of the tetR to the tetO, thereby inducing reporter gene expression.

As an alternate, "Tet-On" systems were generated by fusing the tetR with the C-terminal activation domain of the virion protein 16 (VP16) from herpes simplex virus (HSV), thereby generating a hybrid transactivator (tTA) that stimulates promoters fused to tetO sequences. A modification of four amino acids resulted in a reverse tetracycline transactivator (rtTA) that binds to tetO only in the presence of tetracycline or doxycycline. Oncogenes (c-Myc and Tag) and telomerase (hTERT) were initially tested in Tet-based immortalization systems for mouse embryo fibroblasts (MEFs), murine kidney cells (293T), mouse embryonic stem cells and human endothelial cells. In addition, mesenchymal stromal cells (MSCs) have been immortalized with tetracycline inducible systems. Tetracycline-inducible hTERT-expressing MSC cell lines were found to retain multipotency, and immortalization was dependent on telomere elongation. A conditionally immortalized MSC line was generated by lentiviral transfection of Tag-hTERT in conjunction with a doxycycline/tetracycline-induction (Tet-On) system (Koch et al., *Genome Res.,* 2013; 23:248-259 (2013)). These cells were used to study senescence-associated DNA methylation (SA-DNAm) changes and could be maintained in culture for 80 days without any sign of senescence. Removal of doxycycline in the media resulted in immediate growth arrest, and further expression of senescence-associated β-galactosidase. Telomere length increased significantly when the cells were exposed to the antibiotic and were not affected by SA-DNAm.

Methods of Modifying Cell Vehicles

A number of methods of engineering cells, such as for making the engineered cell vehicles described above, are known in the art. Such methods include, but are not limited to:

(a) CRISPR-CAS9 targeted suppression (permanent gene/locus deletion). Cell vehicles can be transfected with a DNA plasmid that expresses both the CAS9 protein a guide RNA (gRNA) specific for the gene of interest. The gRNA-CAS9-mediated cut in the genome can be repaired using a donor DNA plasmid, which causes specific deletion of the targeted gene and permanent and total loss of the gene-encoded protein. Loss of protein expression can be validated using PCR (DNA level), Northern Blot/FISH (RNA level), or any Protein assay such as, for example western blot or flow cytometry.

(b) CRISPR-CAS9 targeted expression (permanent gene/locus insertion) This method can be used to insert the gene of interest into a specific location of the cell vehicle genome. Cell vehicles can be transfected with a DNA plasmid that expresses both the CAS9 protein a guide RNA (gRNA) specific for the specific insertion location. The gRNA-CAS9-mediated cut in the genome can be repaired using a donor DNA plasmid, which has the inserted gene of interest flanked by sequences of the cell vehicle genome on both sides of the location of the DNA cut/double stranded break, causing homologous recombination-mediated insertion of the gene of interest in the specific genome location rather than randomly. Successful insertion and protein expression can be validated using PCR (DNA level), Northern Blot/FISH (RNA level), or any Protein assay such as, for example, western blot or flow cytometry.

(c) RNA interference (retroviral/lentiviral/transposon-mediated transduction of shRNA/microRNA) (permanent gene suppression) shRNA/microRNA targeting the specific gene/protein of interest can be designed and cloned into a retroviral/lentiviral/transposon vector for stable integration into the cell vehicle genome. Cell vehicles can be transduced with the vector and transduced cells can be selected using the vector encoded selection markers. shRNA-mediated suppression of the gene of interest can be evaluated using, e.g., Northern Blot and Protein assays.

(d) Lentivirus/γ-retrovirus-mediated random/multiple copy gene insertion The specific gene/protein of interest can be designed and/or cloned into a retroviral or lentiviral vector for stable random integration into the cell vehicle genome. Cell vehicles can be transduced with the viral vector, and transduced cells can be selected using the vector encoded selection markers. shRNA-mediated suppression of the gene of interest will be evaluated using Northern Blot and any Protein assays, such as for example, western blot and flow cytometry.

(e) Transposon-mediated random/multiple copy gene insertion The specific gene/protein of interest can be designed and/or cloned into a mammalian transposon vector system such as the PiggyBac (SBI System Biosciences) or equivalent. Cell vehicles can be co-transfected with the transposon vector with the gene (cDNA) of interest flanked by the inverted terminal repeat (ITR) sequences and the Transposase vector. The Transposase enzyme can mediate transfer of a gene of interest into TTAA chromosomal integration sites. Transduced cells optionally can be selected using vector encoded selection markers. Insertion and protein expression can be validated using PCR (DNA level), Northern Blot/FISH (RNA level), or any Protein assay such as, for example western blot or flow cytometry.

(f) Transient gene suppression of the expression of a protein of interest can be achieved, e.g., through RNA interference. siRNA/MicroRNA can be transfected into the cell vehicles by any of the established methodologies known in the art, e.g., calcium chloride transfection; lipofection; Xfect; electroporation; sonoporation and cell squeezing (e.g., to introduce siRNA).

(g) Transient gene expression can be achieved, e.g., by cloning the gene of interest into an appropriate mammalian plasmid expression vector that can be transfected into cell vehicles with plasmid DNA encoding the desired product. Alternatively, mRNA encoding the gene/protein of interest can be transfected directly into the cell vehicles. Transfection can be performed using any of the established methodologies, e.g.: calcium chloride transfection; lipofection; Xfect; electroporation; sonoporation and cell squeezing (e.g., to introduce siRNA).

2. Viruses

The carrier cells selected and/or modified as described above can be used for virotherapy with any virus identified as having oncolytic properties. Exemplary oncolytic viruses that can be used in the methods, combinations and compositions provided herein are as follows:

Types of Viruses

Oncolytic viruses are characterized by their largely tumor cell specific replication, resulting in tumor cell lysis and efficient tumor regression. Oncolytic viruses effect treatment by colonizing or accumulating in tumor cells, including metastatic tumor cells such as circulating tumor cells, and replicating therein. The methods, compositions and combinations can be practiced with any anti-cancer vaccine or virus. For example, the oncolytic virus can be any naturally occurring or engineered recombinant virus such as, but not limited to, vaccinia virus, poxvirus, herpes simplex virus, adenovirus, adeno-associated virus, measles virus, reovirus, vesicular stomatitis virus (VSV), maraba virus, coxsackie virus, Semliki Forest Virus, Seneca Valley Virus, Newcastle Disease Virus, Sendai Virus Dengue Virus, picornavirus, poliovirus, parvovirus, retrovirus, lentivirus, alphavirus, flavivirus, rhabdovirus, papillomavirus, influenza virus, mumps virus, gibbon ape leukemia virus, and Sindbis virus, among others. In many cases, tumor selectivity is an inherent property of the virus, such as vaccinia viruses and other oncolytic viruses. Generally oncolytic viruses effect treatment by replicating in tumors or tumor cells resulting in lysis.

In some embodiments, an attenuated strain derived from a pathogenic virus is used for the manufacturing of a live vaccine. Non-limiting examples of vaccinia viruses include, but are not limited to, Lister (also known as Elstree), New York City Board of Health (NYCBH), Dairen, Ikeda, LC16M8, Western Reserve (WR), Copenhagen (Cop), Tashkent, Tian Tan, Wyeth, Dryvax, IHD-J, IHD-W, Brighton, Ankara, Modified Vaccinia Ankara (MVA), Dairen I, LIPV, LC16M0, LIVP, WR 65-16, EM63, Bern, Paris, CVA382, NYVAC, ACAM2000, ACAM1000 and Connaught strains. The viruses can be clonal strains of an oncolytic virus. The sequence of nucleotides encoding a chromophore-producing enzyme can be inserted into, or in place of, a non-essential gene or region in the genome of an unmodified oncolytic virus, or is inserted into or in place of nucleic acid encoding a heterologous gene product in the genome of an unmodified oncolytic virus.

In some embodiments, the vaccinia virus used with cells and in the methods herein is an attenuated New York City Board of Health (NYCBOH) strain. In some embodiments, the NYCBOH strain of vaccinia virus can be ATCC VR-118 or CJ-MVB-SPX.

In some embodiments, the vaccinia virus is selected from Dryvax, ACAM1000, ACAM2000, Lister, EM63, LIVP, Tian Tan, Copenhagen, Western Reserve, or Modified Vaccinia Ankara (MVA). In some embodiments, the oncolytic virus is not deficient in any genes present in one or more of these strains.

In some embodiments, the virus or vaccine is a replication competent virus. In some embodiments, the virus or vaccine is replication deficient. In some embodiments, the virus or vaccine is non-attenuated. In other embodiments, the virus or vaccine is attenuated.

Other unmodified oncolytic viruses include any known to those of skill in the art, including those selected from among viruses designated GLV-1h68, JX-594, JX-954, ColoAd1, MV-CEA, MV-NIS, ONYX-015, B18R, H101, OncoVEX GM-CSF, Reolysin, NTX-010, CCTG-102, Cavatak, Oncorine, and TNFerade.

Oncolytic viruses for use in the methods provided herein include several well-known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos. 2011/0177032, 2011/0158948, 2010/0092515, 2009/0274728, 2009/0285860, 2009/0215147, 2009/0010889, 2007/0110720, 2006/0039894 and 20040009604; retroviruses, see, e.g., U.S. Pat. Nos. 6,689,871, 6,635,472, 6,639,139, 5,851,529, 5,716,826, 5,716,613 and U.S. Pat. Pub. No. 20110212530; and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Newcastle Disease Virus

Newcastle Disease Virus (NDV) is an avian paramyxovirus with a single-stranded RNA genome of negative polarity that infects poultry and is generally non-pathogenic to humans, but can cause flu-like symptoms (Tayeb et al. (2015) *Oncolytic Virotherapy* 4:49-62; Cheng et al. (2016) *J. Virol.* 90:5343-5352). Due to its cytoplasmic replication, lack of host genome integration and recombination and high genomic stability, NDV and other paramyxoviruses provide safer and more attractive alternatives to other oncolytic viruses, such as retroviruses or some DNA viruses (Matveeva et al. (2015) *Molecular Therapy—Oncolytics* 2, 150017). NDV has been shown to demonstrate tumor selectivity, with 10,000 times greater replication in tumor cells than normal cells, resulting in oncolysis due to direct cytopathic effects and induction of immune responses (Tayeb et al. (2015; Lam et al. (2011) *Journal of Biomedicine and Biotechnology*, Article ID 718710). Though the mechanism of NDV's tumor selectivity is not entirely clear, defective interferon production and responses to IFN signaling in tumor cells allow the virus to replicate and spread (Cheng et al. (2016); Ginting et al. (2017) *Oncolytic Virotherapy* 6:21-30). The high affinity of paramyxoviruses towards cancer cells also can be due to overexpression of viral receptors on cancer cell surfaces, including sialic acid (Cheng et al. (2016); Matveeva et al. (2015); Tayeb et al. (2015)).

Non-engineered NDV strains are classified as lentogenic (avirulent), mesogenic (intermediate), or velogenic (virulent), based on their pathogenicity in chickens, with velogenic and mesogenic strains being capable of replication in (and lysis of) multiple human cancer cell lines, but not lentogenic strains (Cheng et al. (2016); Matveeva et al. (2015)). NDV strains also are categorized as lytic or non-lytic, with only the lytic strains being able to produce viable and infectious progeny (Ginting et al. (2017); Matveeva et al. (2015)). On the other hand, the oncolytic effects of non-lytic strains stems mainly from their ability to stimulate immune responses that result in antitumor activity (Ginting et al. (2017) *Oncolytic Virotherapy* 6:21-30). Mesogenic lytic strains commonly used in oncotherapy include PV701 (MK107), MTH-68/H and 73-T, and lentogenic non-lytic strains commonly used include HUJ, Ulster and Hitchner-B1 (Tayeb et al. (2015); Lam et al. (2011); Freeman et al. (2006) *Mol. Ther.* 13 (1): 221-228).

The use of NDV as an oncolytic virus was first reported in the early 1950s, when adenovirus and NDV were injected directly into a uterine carcinoma, resulting in partial necrosis. Tumor regrowth was observed, likely due to suppression of oncolytic activity by the production of neutralizing antibodies against the virus (Lam et al. (2011) *Journal of Biomedicine and Biotechnology*, Article ID 718710). More recently, NDV strain PV701 displayed activity against colorectal cancer in a phase 1 trial (Laurie et al. (2006) *Clin. Cancer Res.* 12 (8): 2555-2562), while NDV strain 73-T demonstrated in vitro oncolytic activity against various human cancer cell lines, including fibrosarcoma, osteosarcoma, neuroblastoma and cervical carcinoma, as well as in vivo therapeutic effects in mice bearing human neuroblastomas, fibrosarcoma xenografts and several carcinoma xenografts, including colon, lung, breast and prostate cancer xenografts (Lam et al. (2011)). NDV strain MTH-68/H resulted in significant regression of tumor cell lines, including PC12, MCF7, HCT116, DU-145, HT-29, A431, HELA, and PC3 cells, and demonstrated favorable responses in patients with advanced cancers when administered by inhalation (Lam et al. (2011)). The non-lytic strain Ulster demonstrated cytotoxic effects against colon carcinoma, while the lytic strain Italien effectively killed human melanomas (Lam et al. (2011)). Lentogenic NDV strain HUJ demonstrated oncolytic activity against recurrent gliobastoma multiforme when administered intravenously to patients, while lentogenic strain LaSota prolonged survival in colorectal cancer patients (Lam et al. (2011); Freeman et al. (2006) *Mol. Ther.* 13 (1): 221-228) and was capable of infecting and killing non-small cell lung carcinoma (A549), glioblastoma (U87 MG and T98G), mammary gland adenocarcinoma (MCF7 and MDA-MB-453) and hepatocellular carcinoma (Huh7) cell lines (Ginting et al. (2017) *Oncolytic Virotherapy* 6:21-30).

Genetically engineered NDV strains also have been evaluated for oncolytic therapy. For example, the influenza NS1 gene, an IFN antagonist, was introduced into the genome of NDV strain Hitchner-B1, resulting in an enhanced oncolytic effect in a variety of human tumor cell lines and a mouse model of B16 melanoma (Tayeb et al. (2015)). The antitumor/immunostimulatory effects of NDV have been augmented by introduction of IL-2 or GM-CSF genes into the viral genome (Lam et al. (2011)).

In addition to the use of free virus, studies have evaluated the use of NDV oncolysates, NDV-infected cell-based vehicles, and combination therapies with other noncancer agents for cancer therapy. In several clinical trials, NDV oncolysates demonstrated oncolytic activity against malignant melanomas (Lam et al. (2011)). The use of NDV-infected cell-based carriers also has been demonstrated. Autologous tumor cell lines infected with NDV were used against colorectal, breast, ovarian, kidney, head and neck cancers and glioblastomas (Lam et al. (2011)). MSCs derived from bone marrow, adipose and umbilical cord that were infected with NDV strain MTH-68/H delivered the virus to co-cultured A172 and U87 glioma cells and glioma stem cells, resulting in dose-dependent cell death in glioma cells, a low level of apoptosis and inhibition of self-renewal in glioma stem cells, and higher levels of apoptosis than direct infection with naked virus (Kazimirsky et al. (2016) *Stem Cell Research & Therapy* 7:149). Combination therapy, using intratumoral NDV injection with systemic CTLA-4 antibody administration resulted in the efficient rejection of pre-established distant tumors (Matveeva et al. (2015)).

Maraba Virus

Maraba virus was first isolated from Amazonian phlebotomine sand flies in Brazil and has not been detected outside South America to date. Phylogenetically, Maraba virus belongs to the vesiculovirus genus of the Rhabdoviridae family and is genetically distinct from but shares some homology with the prototypical vesicular stomatitis virus (VSV) (see Pol et al., *Oncolytic Virother.,* 7:117-128 (2018) and references cited therein, the contents of which are incorporated in their entirety by reference herein).

Among 20 strains of rhabdoviruses that were screened for oncolytic Maraba virus showed the broadest oncotropism. The virus was the only candidate to complete a lytic cycle in all human and murine cell lines tested and derived from a variety of cancer types (i.e., breast, brain, colon, skin, lung, ovarian, mammary, prostate, and renal cancers). Maraba virus (like VSV) exploits, yet not exclusively, the ubiquitous low-density lipoprotein receptor (LDLR) for its entry in the target cells providing one explanation for the wide range of malignant cell hosts infected. Consistent with this, reduced expression of LDLR was associated with a decreased susceptibility to Maraba virus entry and killing in some cell lines derived from ovarian cancer patient ascites.

To enhance Maraba virus replication in malignant cells, its genome was genetically engineered. Two single mutations were introduced, which translated into the L123W and Q242R substitutions in the sequence of the M and G proteins, respectively. In vitro, the resulting strain, named MG1, demonstrated a faster replication, a larger burst size, and an increased killing potency in tumor cells, in comparison to the wild-type (wt) and to other mutant strains of Maraba virus. Inversely, MG1 was strongly attenuated in normal primary cells, validating its oncoselectivity (Brun et al., *Mol. Ther.* 18 (8): 1440-1449 (2010)).

In vitro, MG1 oncolytic activity has been validated against multiple adherent cancer cell lines of human, canine, and murine origins (e.g., central nervous system cancer, sarcoma, breast cancer and colon cancer origins). In addition, it was found that MG1 was able to infect, replicate, and induce cell death in ovarian cancer cells, regardless of the stage (Tong et al., *Mol. Ther. Oncolytics,* 2:15013 (2015)). Ex vivo, the MG1 strain was found to display productive infection and significant cytopathic effect against resected tissues originating from prostate cancer, head and neck squamous cell carcinoma, or sarcomas. In vivo, MG1 could safely be delivered systemically, allowing for the treatment of not only localized but also disseminated cancerous lesions. The oncolytic activity of MG1 was confirmed in multiple syngeneic murine tumor models and in xenograft models using human cancer cell lines or patient-derived tumors implanted in immunodeficient mice (e.g., in mouse: colon cancer (CT26, CT26lacZ), leukemia (L1210), lung cancer (TC1), mammary gland cancer (E0771, EMT6, 4T1), prostatic cancer (TRAMP-C2), sarcoma (S180), skin cancer (B16F10, B16F10Ova, B16lacz); in human: breast cancer (HCl-001, HCl-003), and ovarian cancer (ES2, OVCAR4).

The activity of the MG1 strain of the Maraba vesiculovirus relies not only on a direct cytotoxicity but also on the induction of both innate and adaptive antitumor immunity. Thus, the Maraba virus can function both as a selective tumor-destroying oncolytic virus and as an immune-stimulating T cell vaccine. Leaving healthy cells unaffected, the Maraba platform directly attacks cancer cells and changes the tumor microenvironment to make the cancer susceptible to the targeted vaccine-induced immune response. This technology has been developed by Turnstone Biologics (Ottawa, Ontario), a clinical-stage immuno-oncology company that recently entered into a research, option and license agreement with Abb Vie (North Chicago, IL) for an exclusive option to license up to three of Turnstone's next-generation oncolytic viral immunotherapies.

Parvovirus

H-1 parvovirus (H-1PV) is a small, non-enveloped single-stranded DNA virus belonging to the family Parvoviridae, whose natural host is the rat (Angelova et al. (2017) *Front. Oncol.* 7:93; Angelova et al. (2015) *Frontiers in Bioengineering and Biotechnology* 3:55). H-1PV is nonpathogenic to humans, and is attractive as an oncolytic virus due to its favorable safety profile, the absence of preexisting H-1PV immunity in humans and their lack of host cell genome integration (Angelova et al. (2015)). H-1PV has demonstrated broad oncosuppressive potential against both solid tumors, including preclinical modes of breast, gastric, cervical, brain, pancreatic and colorectal cancer, as well as hematological malignancies, including lymphoma and leukemia Angelova et al. (2017) *Front. Oncol.* 7:93; Angelova et al. (2015) *Frontiers in Bioengineering and Biotechnology* 3:55). H-1PV stimulates anti-tumor responses via the increased presentation of tumor-associated antigens, maturation of dendritic cells and the release of pro-inflammatory cytokines (Moehler et al. (2014) *Frontiers in Oncology* 4:92). H-1PV also displays tumor selectivity, which is thought to be due to the availability of cellular replication and transcription factors, the overexpression of cellular proteins that interact with the NS1 parvoviral protein, and the activation of metabolic pathways involved in the functional regulation of NS1 in tumor cells, but not normal cells (Angelova et al. (2015) *Frontiers in Bioengineering and Biotechnology* 3:55). Due to the innocuous nature of H-1PV, the wild type strain is often used, negating the need for attenuation by genetic engineering (Angelova et al. (2015)).

Studies have shown that oncolytic H-1PV infection of human glioma cells resulted in efficient cell killing, and high-grade glioma stem cell models also were permissive to lytic H-1PV infection. Enhanced killing of glioma cells has been observed when the virus was applied shortly after tumor cell irradiation, indicating that this protocol can be useful in non-resectable recurrent glioblastoma (Angelova et al. (2017) *Front. Oncol.* 7:93; Angelova et al. (2015) *Frontiers in Bioengineering and Biotechnology* 3:55). Intracerebral or systemic H-1PV injection led to regression of gliomas without toxic side effects in immunocompetent rats with orthotopic RG-2 tumors, as well as immunodeficient animals implanted with human U87 gliomas (Angelova et al. (2015) *Frontiers in Bioengineering and Biotechnology* 3:55). Del H-1PV, a fitness variant with higher infectivity and spreading in human transformed cell lines, demonstrated oncolytic effects in vivo in pancreatic cancer and cervix carcinoma xenograft models (Geiss et al. (2017) *Viruses* 9, 301). H-1PV also demonstrated oncolytic activity against a panel of five human osteosarcoma cell lines (CAL 72, H-OS, MG-63, SaOS-2, U-2OS) (Geiss et al. (2017) *Viruses* 9, 301) and against human melanoma cells (SK29-Mel-1, SK29-Mel-1.22) (Moehler et al. (2014) *Frontiers in Oncology* 4:92). In another study, nude rats bearing cervical carcinoma xenografts demonstrated dose-dependent tumor growth arrest and regression following treatment with H-1PV (Angelova et al. (2015) *Frontiers in Bioengineering and Biotechnology* 3:55). The intratumoral and intravenous administration of H-1PV also demonstrated significant growth suppression in human mammary carcinoma xenografts in immunocompromised mice (Angelova et al. (2015) *Frontiers in Bioengineering and Biotechnology* 3:55). Intratumoral H-1PV injection in human gastric carcinoma or human Burkitt lymphoma-bearing mice resulted in tumor regression and growth suppression (Angelova et al. (2015) *Frontiers in Bioengineering and Biotechnology* 3:55).

The first phase I/IIa clinical trial of an oncolytic H-1PV (ParvOryx01) in recurrent glioblastoma multiforme patients was completed in 2015 (clinical trial NCT01301430), and demonstrated favorable progression-free survival, clinical safety and patient tolerability with intratumoral or intravenous injection (Angelova et al. (2017); Geiss et al. (2017) *Viruses* 9, 301; Geletneky et al. (2017) *Mol. Ther.* 25 (12): 2620-2634). This trial demonstrated the ability of H-1PV to cross the blood-brain barrier in a dose-dependent manner and to establish an immunogenic anti-tumor response, characterized by leukocytic infiltration, predominantly by CD8+ and CD4+T lymphocytes, and the detection in locally treated tumors of several markers of immune cell activation, including perforin, granzyme B, IFNγ, IL-2, CD25 and CD40L (Geletneky et al. (2017) Mol. Ther. 25 (12): 2620-2634).

H-1PV also has demonstrated efficient killing of highly aggressive pancreatic ductal adenocarcinoma (PDAC) cells in vitro, including those resistant to gemcitabine, and intratumoral injection of H-1PV resulted in tumor regression and prolonged animal survival in an orthotopic rat model of PDAC (Angelova et al. (2017); Angelova et al. (2015)). Similar results, including selective tumor targeting and absence of toxicity, were observed in an immunodeficient nude rat PDAC model (Angelova et al. (2015)). The combination of H-1PV and cytostatic (cisplatin, vincristine) or targeted (sunitinib) drugs results in the synergistic induction of apoptosis in human melanoma cells (Moehler et al. (2014)). The combination of H-1PV and valproic acid, an HDAC inhibitor, resulted in synergistic cytotoxicity towards cervical and pancreatic cells (Angelova et al. (2017)), while the therapeutic efficiency of gemcitabine was significantly improved when combined with H-1PV in a two-step protocol (Angelova et al. (2015)). As with other viruses, H-1PV also can be engineered to express anti-cancer molecules. For example, studies have shown that a parvovirus-H1-derived vector expressing Apoptin had a greater capacity to induce apoptosis than wild-type H-1PV (Geiss et al. (2017)).

As with other oncolytic viruses, the therapeutic potential of parvoviruses is limited by nonspecific uptake due to the ubiquitous expression of cell surface receptors that recognize them, and due to the development of neutralizing antibodies following repeated administration. H-1PV has demonstrated anti-tumor effects when combined with cell-based vehicles, circumventing these potential issues. In one study, autologous MH3924A rat hepatoma cells were used for the targeted delivery of H-1PV and suppression of metastases formed by the same cells (Raykov et al. (2004) *Int. J. Cancer* 109:742-749). The hepatoma cells were inactivated by γ-radiation 24 h following infection with H-1PV, which only reduced progeny virus yields by 2-fold or less. In comparison to direct virus injection, the vehicle cell-based therapy results in improved suppression of metastases and the generation of fewer neutralizing antibodies, supporting the use of carrier cells to deliver oncolytic parvoviruses systemically (Raykov et al. (2004)).

Measles Virus

Measles virus (MV) is an enveloped, single-stranded RNA virus with a negative-sense genome that belongs to the family of Paramyxoviruses (Aref et al. (2016) *Viruses* 8:294; Hutzen et al. (2015) *Oncolytic Virotherapy* 4:109-118). Its non-segmented genome is stable, with a low risk of mutating and reverting to its pathogenic form, and due to its replication in the cytoplasm, poses no risk of insertional DNA mutagenesis in infected cells (Aref et al. (2016); Hutzen et al. (2015)). MV was first isolated from a patient called Edmonston in 1954, and developed into a live vaccine with an excellent safety profile, that has protected over a billion individuals worldwide for 50 years, by attenuation following multiple in vitro passages (Aref et al. (2016) *Viruses* 8:294; Hutzen et al. (2015) *Oncolytic Virotherapy* 4:109-118). Derivatives of this strain, denoted as MV-Edm, are the most commonly used MV strains in oncolytic therapy studies. The Schwarz/Moraten measles vaccine strain is more attenuated and immunogenic than Edm derivatives, which makes them safer and more immunomodulatory (Veinalde et al. (2017) *Oncoimmunology* 6 (4): e1285992). The oncolytic effects of wildtype MV were documented in the 1970s, with reports of improvements in patients with acute lymphoblastic leukemia, Burkitt's lymphoma and Hodgkin's lymphoma (Aref et al. (2016)).

MV uses three main receptors for entry into target cells: CD46, nectin-4 and signaling lymphocyte activation molecule (SLAM) (Aref et al. (2016); Hutzen et al. (2015)). Whereas SLAM, which is expressed on activated B and T cells, immature thymocytes, monocytes and dendritic cells, is the main receptor for wildtype strains, attenuated and tumor-selective MV-Edm strains primarily target the CD46 receptor, a regulator of complement activation that is overexpressed in many tumor cells (Aref et al. (2016); Hutzen et al. (2015); Jacobson et al. (2017) *Oncotarget* 8 (38): 63096-63109; Msaouel et al. (2013) Expert Opin. Biol. Ther. 13 (4)). Nectin-4, which is predominantly expressed in the respiratory epithelium, is used by wildtype and attenuated MV strains (Aref et al. (2016); Msaouel et al. (2013) *Expert Opin. Biol. Ther.* 13 (4)). As with other oncolytic viruses, defects in the IFN antiviral response of tumor cells also facilitates the tumor-selectivity of MV (Aref et al. (2016); Jacobson et al. (2017) *Oncotarget* 8 (38): 63096-63109. MV has been studied in clinical trials for treatment of several cancers, including multiple myeloma (NCT02192775, NCT00450814), head and neck cancer (NCT01846091), mesothelioma (NCT01503177), and ovarian cancer (NCT00408590, NCT02364713).

MV has been genetically engineered to express immune-stimulating and immunomodulatory genes, including those encoding IL-13, INF-beta, GM-CSF and *Heliobacter pylori* neutrophil-activating protein (NAP), for example (Aref et al. (2016), Hutzen et al. (2015); Msaouel et al. (2013) *Expert*

*Opin. Biol. Ther.* 13 (4)). Combination therapies using oncolytic MV with anti-CTLA4 and anti-PD-L1 antibodies have been shown to be effective in melanoma mouse models (Aref et al. (2016); Hutzen et al. (2015)). Due to widespread vaccination or previous natural infection, most patients have prior immunity to MV, which hinders its therapeutic potential. To circumvent this, MV has been delivered to tumors in carrier cells, such as mesenchymal stromal cells, effectively evading the host neutralizing antibodies and proving effective in pre-clinical models of acute lymphoblastic leukemia, hepatocellular carcinoma and ovarian carcinoma (Aref et al. (2016)). Several other cell carriers have demonstrated results for the delivery of MV, including the U-937 monocytic cell line, immature and mature primary dendritic cells, PMBCs, activated T cells, primary CD14+ cells, the multiple myeloma MM1 cell line and blood outgrowth endothelial cells (Msaouel et al. (2013) Expert Opin. Biol. Ther. 13 (4)). A clinical trial (NCT02068794) has studied the use of oncolytic MV infected mesenchymal stem cells in the treatment of patients with recurrent ovarian cancer. Another strategy to overcome pre-existing immunity involves the combination of MV therapy with immunosuppressive agents such as cyclophosphamide (Hutzen et al. (2015)).

MV-CEA

MV-CEA, which is genetically engineered to express the tumor marker carcinoembryonic antigen (CEA), results in the release of CEA into the blood stream of patients following infection of cancer cells, allowing the detection of CEA levels and thus, the tracking of in vivo viral infection (Aref et al. (2016); Hutzen et al. (2015)). The therapeutic potential of MV-CEA has been demonstrated pre-clinically, and has been in Phase I clinical trials for the treatment of ovarian cancer (NCT00408590).

MV-NIS

MV-NIS is another trackable oncolytic MV of the Edmonston vaccine lineage, engineering to express the sodium iodide symporter (NIS), which displays superior viral proliferation compared to MV-CEA, due to the positioning of the NIS transgene downstream of the hamagglutinin (H) gene of the MV genome, instead of upstream of the nucleocapsid (N) gene, as in the MV-CEA construct (Aref et al. (2016); Galanis et al. (2015) *Cancer Res.* 75 (1): 22-30). Radioisotopes such as $^{123}$I, $^{124}$I, $^{125}$I, $^{131}$I and $^{99m}$Tc are transported via NIS, which is expressed on MV-NIS infected cells, allowing for non-invasive imaging using, for example, PET, SPECT/CT, and γcamera (Msaouel et al. (2013) *Expert Opin. Biol. Ther.* 13 (4)). The expression of NIS also can improve the efficacy of oncolytic MV by facilitating the entry of beta-emitting radioisotopes, such as I-131, into tumor cells for radiovirotherapy, and has demonstrated results pre-clinically in multiple myeloma, glioblastoma multiforme, head and neck cancer, anaplastic thyroid cancer and prostate cancer models (Aref et al. (2016); Hutzen et al. (2015); Msaouel et al. (2013)). Several Phase I/II clinical trials have been conducted to investigate the use of MV-NIS in multiple myeloma (NCT00450814, NCT02192775), mesothelioma (NCT01503177), head and neck cancer (NCT01846091) and in ovarian cancer using virus-infected MSCs (NCT02068794).

Reovirus

Respiratory Enteric Orphan virus, commonly known as Reovirus, is a non-enveloped double-stranded RNA virus of the Reoviridae family that is nonpathogenic to humans. Wild-type reovirus is ubiquitous throughout the environment, resulting in a 70-100% seropositivity in the general population (Gong et al. (2016) *World J. Methodol.* 6 (1): 25-42). There are three serotypes of reovirus, which include type 1 Lang, type 2 Jones, type 3 Abney and type 3 Dearing (T3D). T3D is the most commonly used naturally occurring oncolytic reovirus serotype in pre-clinical and clinical studies.

Oncolytic reovirus is tumor-selective due to activated Ras signaling that is characteristic of cancer cells (Gong et al. (2016); Zhao et al. (2016) Mol. Cancer Ther. 15 (5): 767-773). Activation of the Ras signaling pathway disrupts the cell's anti-viral responses, by inhibiting the phosphorylation of dsRNA-dependent protein kinase (PKR), a protein that is normally responsible for preventing viral protein synthesis (Zhao et al. (2016)). Ras activation also enhances viral un-coating and disassembly, results in enhanced viral progeny generation and infectivity, and accelerates the release of progeny through enhanced apoptosis (Zhao et al. (2016)). It is estimated that approximately 30% of all human tumors display aberrant Ras signaling (Zhao et al. (2016)). For example, the majority of malignant gliomas possess activated Ras signaling pathways, with reovirus demonstrating antitumor activity in 83% of malignant glioma cells in vitro, as well as in vivo in human malignant glioma models, and in 100% of glioma specimens ex vivo (Gong et al. (2016) World J. Methodol. 6 (1): 25-42). Additionally, pancreatic adenocarcinomas display a very high incidence of Ras mutations (approximately 90%), and reovirus has shown potent cytotoxicity in 100% of pancreatic cell lines tested in vitro and induced regression in 100% of subcutaneous tumor mouse models in vivo (Gong et al. (2016)).

Reovirus has demonstrated broad anticancer activity pre-clinically across a spectrum of malignancies including colon, breast, ovarian, lung, skin (melanoma), neurological, hematological, prostate, bladder, and head and neck cancer (Gong et al. (2016)). Reovirus therapy has been tested in combination with radiotherapy, chemotherapy, immunotherapy, and surgery. The combination of reovirus and radiation therapy has proven beneficial in the treatment of head and neck, colorectal and breast cancer cell lines in vitro, as well as colorectal cancer and melanoma models in vivo (Gong et al. (2016)). The combination of reovirus and gemcitabine, as well as reovirus, paclitaxel and cisplatin, have proven successful in mouse tumor models (Zhao et al. (2016)). Preclinical studies in B16 melanoma mouse models have shown that the combination of oncolytic reovirus and anti-PD-1 therapy demonstrated improved anticancer efficacy in comparison to reovirus alone (Gong et al. (2016); Zhao et al. (2016); Kemp et al. (2015) Viruses 8, 4).

There have been numerous clinical trials with reovirus. Reolysin® reovirus (Oncolytics Biotech® Inc.) has demonstrated anticancer activity alone against malignancies, and in combination with other therapeutics. For example, a phase I clinical study of Reolysin® reovirus for treatment of recurrent malignant gliomas (NCT00528684) found that the reovirus was well tolerated, and a phase I/II trial showed that Reolysin® reovirus is able to kill tumor cells without damaging normal cells in patients with ovarian epithelial cancer, primary peritoneal cancer, and fallopian tube cancer that did not respond to platinum chemotherapy (NCT00602277). A phase II clinical trial of Reolysin® reovirus showed that it was safe and effective in the treatment of patients with bone and soft tissue sarcomas metastatic to the lung (NCT00503295). Reolysin® reovirus in combination with FOLFIRI and bevacizumab has been in clinical trials for patients with metastatic colorectal cancer (NCT01274624). A phase II clinical trial of Reolysin® reovirus in combination with the chemotherapeutic gemcitabine was carried out in patients with advanced pancreatic adenocarcinoma (NCT00998322), a phase II clinical study investigated the therapeutic potential of Reolysin® reovirus in combination with docetaxel in metastatic castration resistant prostate cancer (NCT01619813), and a phase II clinical trial investigated the combination of Reolysin® reovirus with paclitaxel in patients with advanced/metastatic breast cancer (NCT01656538). A phase III clinical trial investigated the efficacy of Reolysin® reovirus in combination with paclitaxel and carboplatin in platinum-refractory head and neck cancers (NCT01166542), while phase II clinical studies employing this combination therapy were carried out in patients with non-small cell lung cancer (NCT00861627) and metastatic melanoma (NCT00984464). A phase I clinical trial of Reolysin® reovirus in combination with carfilzomib and dexamethasone in patients with relapsed or refractory multiple myeloma is ongoing (NCT02101944).

Due to the presence of neutralizing antibodies in the majority of the population, systemic administration of reovirus has limited therapeutic potential, which can be overcome with the co-administration of reovirus with immunosuppressive agents, such as cyclosporin A or cyclophosphamide (Gong et al. (2016)). The administration of GM-CSF prior to IV administration of reovirus resulted in significant reduction of B16 melanoma tumors and prolonged survival in mice (Kemp et al. (2015) *Viruses* 8, 4). Carrier cells also have demonstrated success in shielding the virus from pre-existing immunity. For example, lymphokine-activated killer cells (LAKs) and DCs were used as cell carriers for reovirus in a model of ovarian cancer, and protected the virus from neutralizing antibodies (Zhao et al. (2016)). PMBCs, including NK cells, have been shown to not only transport reovirus, but also were stimulated by reovirus to kill the tumor targets (Zhao et al. (2016)). Another study showed that both DCs and T cells were effective carriers of reovirus in vitro in the absence of human serum, but only DCs delivered the virus to melanoma cells in the presence of neutralizing serum (Ilett et al. (2011) Clin. Cancer Res. 17 (9): 2767-2776). DCs also were capable of delivering reovirus in mice bearing lymph node B16tk melanoma metastases, whereas neat reovirus was completely ineffective (Ilett et al. (2009) *Gene Ther.* 16 (5): 689-699).

Vesicular Stomatitis Virus (VSV)

Vesicular stomatitis virus (VSV) is a member of the Vesiculovirus genus within the Rhabdoviridae family. Its genome, which contains a single-stranded RNA with negative-sense polarity, contains 11,161 nucleotides and encodes for five genes: nucleocapsid protein (N), phosphoprotein (P), matrix protein (M), glycoprotein (G), and large polymerase protein (L) (Bishnoi et al. (2018) Viruses 10 (2), 90). VSV is transmitted by insect vectors and disease is limited to its natural hosts, including horses, cattle and pigs, with mild and asymptomatic infection in humans (Bishnoi et al. (2018) *Viruses* 10 (2), 90). VSV is a potent and rapid inducer of apoptosis in infected cells, and has been shown to sensitize chemotherapy-resistant tumor cells. VSV has been shown to infect tumor vasculature, resulting in a loss of blood flow to the tumor, blood-coagulation and lysis of neovasculature. This virus also is capable of replication and induction of cytopathic effects and cell lysis in hypoxic tissues. In addition, WT VSV grows to high titers in a variety of tissue culture cells lines, facilitating large-scale virus production, it has a small and easy to manipulate genome, and it replicates in the cytoplasm without risk of host cell transformation (Bishnoi et al. (2018); Felt and Grdzelishvili (2017) *Journal of General Virology* 98:2895-2911). These factors, together with the fact that it is not pathogenic to humans and there is generally no pre-existing human immunity to VSV, make it a good candidate for viral oncotherapy.

Although VSV can attach to ubiquitously expressed cell-surface molecules, making it "pantropic," it WT VSV is sensitive to type I IFN responses and thus displays oncoselectivity based on the defective or inhibited type I IFN signaling of tumors (Felt and Grdzelishvili (2017)). Due to its infectivity of normal cells, VSV can cause neuropathogenicity, but can be attenuated by modifying its matrix protein and/or glycoprotein. For example, the matrix protein can be deleted or the methionine residue at position 51 of the matrix protein can be deleted or substituted with arginine (Bishnoi et al. (2018); Felt and Grdzelishvili (2017)). Another approach replaces the glycoprotein of VSV with that of lymphocytic choriomeningitis virus (LCMV) (rVSV-GP) (Bishnoi et al. (2018); Felt and Grdzelishvili (2017)). VSV also can be genetically modified to include suicide genes, such as herpes virus thymidine kinase (TK), or to express immune-stimulatory cytokines such as IL-4, IL-12, IFNβ, or costimulatory agents such as granulocyte-macrophage-colony-stimulating factor 1 (GM-CSF1), to enhance oncolytic activity (Bishnoi et al. (2018). VSV-IFNß-sodium iodide symporter (VSV-IFNβ-NIS), which encodes NIS and IFNβ, has been tested in several phase I clinical trials (see, e.g., ClinicalTrials.gov for trials NCT02923466, NCT03120624 and NCT03017820).

Vesicular stomatitis virus (VSV) is an effective oncolytic therapeutic when administered intravenously (IV) in a variety of murine cancer models. In one study, VSV-GP was successful in the intratumoral treatment of subcutaneously engrafted G62 human glioblastoma cells, as well as the intravenous treatment of orthotopic U87 human glioma cells, in immune-deficient mouse models. Intratumoral injection of VSV-GP also was effective against intracranial CT2A murine glioma cells (Muik et al. (2014) Cancer Res. 74 (13): 3567-3578). It was found that VSV-GP did not elicit a detectable neutralizing antibody response, and that this genetically modified oncolytic virus was insensitive to human complement, remaining stable over the length of the experiment (Muik et al. (2014)). In another example, intratumoral administration of VSV-GP was found to effectively infect and kill human A375 malignant melanoma cells transplanted in a mouse model, as well as the murine B16 melanoma cell line (Kimpel et al. (2018) Viruses 10, 108). Intravenous injection of the oncolytic virus was not successful, and even in the intratumorally-administered groups, the tumors all eventually grew, due to type I IFN responses (Kimpel et al. (2018)). In another study, a subcutaneous xenograft mouse model with A2780 human ovarian cancer cells was treated with intratumoral injection of VSV-GP, and although tumor remission was initially observed with no neurotoxicity, remission was temporary and the tumors recurred. This was found to be due to type I IFN responses, with an observed reversal of the antiviral state by combining VSV-GP with the JAK1/2 inhibitor ruxolitinib. (Dold et al. (2016) *Molecular Therapy—Oncolytics* 3, 16021). Inhibition of type I IFN responses often is not be possible for attenuated variants of wild type VSV in vivo due to safety concerns, giving rise to the need for an alternative solution.

Studies have shown that humoral immunity, giving rise to anti-virus antibodies, limits the therapeutic potential of VSV. It was found that repeated administration of VSV in carrier cells to animals bearing metastatic tumors resulted in a much higher therapeutic efficacy in comparison to the injection of naked virions (Power et al. (2007) *Molecular Therapy* 15 (1): 123-130), demonstrating the ability for carrier cells to evade the circulating antibodies. Syngeneic CT26 murine colon carcinoma cells were readily infected with VSV, and following intravenous administration, accumulated rapidly in lung tumors, but not in surrounding normal lung tissue, where they remained until releasing virus and undergoing lysis within 24 h (Power et al. (2007)) at the delivery of VSV to infect lung tumors in mice, illustrating that cell-mediated delivery of VSV can be achieved using immunologically incompatible cells (Power et al. (2007)). L1210 murine leukemia cells also delivered VSV to lung tumors, as well as subcutaneous tumors located in the hind flank of the mice (Power et al. (2007)). When these VSV infected leukemia cells were administered to mice without tumors, there was no detectable virus replication in normal tissues, indicating tumor selectivity.

In another study, VSV-δ51, which lacks the methionine 51 of the matrix protein and thus cannot block the nuclear export of IFN-encoding mRNAs, was loaded onto OT-I CD8+ T cells expressing a transgenic T cell receptor specifically for the SIINFEKL epitope of ovalbumin antigen, which is expressed by B16ova tumors (Qiao et al. (2008) *Gene Ther.* 15 (8): 604-616). This oncolytic virus/cell-based vehicle combination was used against B16ova tumors in the lungs of immune-competent C57Bl/6 mice, and resulted in significant increases in therapeutic efficacy when compared to the use of virus or T cells alone. There was no detectable replication of VSV within the OT-I cells, but virus was released and effectively infected, replicated in, and killed tumor cells following co-culture of infected T cells with B16ova cells. The loading of VSV onto the T cells was shown to increase T-cell activation in vitro and increase trafficking of the T cells to the tumors in vivo (Qiao et al. (2008)).

Adenovirus

Adenoviruses (Ads) are non-enveloped ds-DNA viruses with a linear genome that were first discovered in 1953 by Wallace Rowe and colleagues, and were tested for the treatment of cervical cancer as early as 1956 (Choi et al. (2015) *J. Control. Release* 10 (219): 181-191). Human Ads are ubiquitous in the environment and are classified into 57 serotypes (Ad1-Ad57), based on cross-susceptibility, and 7 subgroups (A-G), based on virulence and tissue tropism. Adenovirus serotype 5 (Ad5) is the most commonly used adenovirus for oncolytic virotherapy. Infections in humans are mild and result in cold-like symptoms (Yokoda et al. (2018) *Biomedicines* 6, 33) and systemic administration results in liver tropism and can lead to hepatotoxicity (Yamamoto et al. (2017) Cancer Sci. 108:831-837), but Ads are considered safe for therapeutic purposes. Ads enter cells by attaching to the coxsackievirus and adenovirus receptor (CAR), followed by interaction between the αvβ3 and αvβ5 integrins on the cell surface and the Arg-Gly-Asp tripeptide motif (RGD) at the adenoviral penton base (Jiang et al. (2015) *Curr. Opin. Virol.* 13:33-39). CAR is expressed on the surfaces of most normal cells, but expression is highly variable across cancer cell types. On the other hand, RGD-related integrins are highly expressed by cancer cells, but are expressed at much lower levels in normal cells (Jiang et al. (2015)). As a result, Ads are often targeted to cancer cells via the RGD motif.

Ads are attractive as oncolytic viruses due to their high transduction efficiency in transformed cells, their lack of integration into the host genome/lack of insertional mutagenesis, their genomic stability, the ability to insert large therapeutic genes into their genomes, and their capacity for tumor selectivity via genetic manipulation, such as the substitution of viral promoters with cancer tissue-selective promoters (Yokoda et al. (2018) *Biomedicines* 6, 33; Choi et al. (2015) *J. Control. Release* 10 (219): 181-191).

Examples of oncolytic Ads with tumor-specific promoters include CV706 for prostate cancer treatment, with the adenovirus early region 1A (E1A) gene under control of the prostate specific antigen promoter, and OBP-301, which uses the telomerase reverse transcriptase (TERT) promoter for regulation of E1A gene expression (Yamamoto et al. (2017) *Cancer Sci.* 108:831-837). Another method for inducing tumor selectivity is the introduction of mutations in the El region of the Ad genome, where the missing genes are functionally complemented by genetic mutations commonly found in tumor cells, such as abnormalities in the retinoblastoma (Rb) pathway or p53 mutations (Yamamoto et al. (2017) *Cancer Sci.* 108:831-837). For example, the oncolytic Ads ONYX-015 and H101 have deletions in the E1B55K gene, which inactivates p53. These mutants cannot block the normal apoptotic defense pathway, resulting in tumor selectivity via the infection of neoplastic cells with defective p53 tumor suppressor pathways (Yamamoto et al. (2017) Cancer Sci. 108:831-837; Uusi-Kerttula et al. (2015) Viruses 7:6009-6042). E1AA24 is an oncolytic Ad that contains a 24-bp mutation in the ELA gene, disrupting the Rb-binding domain and promoting viral replication in cancer cells with Rb pathway mutations. ICOVIR-5 is an oncolytic Ad that combines E1A transcriptional control by the E2F promoter, the 424 mutation of ELA and an RGD-4C insertion into the adenoviral fiber (Yamamoto et al. (2017) Cancer Sci. 108:831-837; Uusi-Kerttula et al. (2015)). Delta-24-RGD, or DNX-2401, is an oncolytic Ad in which the A24 backbone is modified by insertion of the RGD motif, that demonstrated enhanced oncolytic effects in vitro and in vivo (Jiang et al. (2015)).

An alternative strategy for improving tumor selectivity involves overcoming the physical barrier in solid tumors by targeting the extracellular matrix (ECM). For example, VCN-01, is an oncolytic Ad that expresses hyaluronidase in vivo to enhance spread of the virus in a tumor. Ads also have been engineered to express relaxin to disrupt the ECM (Yamamoto et al. (2017) Cancer Sci. 108:831-837; Shaw and Suzuki (2015) *Curr. Opin. Virol.* 21:9-15). Ads expressing suicide genes, such as cytosine deaminase (CD) and HSV-1 thymidine kinase (TK) have enhanced antitumor efficacy in vivo, as have Ads expressing immunostimulatory cytokines, such as ONCOS-102, which expresses GM-CSF (Yamamoto et al. (2017) *Cancer Sci.* 108:831-837; Shaw and Suzuki (2015) *Curr. Opin. Virol.* 21:9-15). A A24-based oncolytic Ad expressing an anti-CTLA4 antibody has shown results in preclinical studies (Jiang et al. (2015)).

The adenovirus H101 (Oncorine® adenovirus) was the first oncolytic Ad approved for clinical use in China in combination with chemotherapy, for treating patients with advanced nasopharyngeal cancer in 2005. Many clinical trials have investigated the use of oncolytic adenoviruses for the treatment of a wide variety of cancers. For example, ongoing and past clinical trials include studies involving Ad5 encoding IL-12 in patients with metastatic pancreatic cancer (NCT03281382); an immunostimulatory Ad5 (LOAd703) expressing TMX-CD40L and 41BBL in patients with pancreatic adenocarcinoma, ovarian cancer, biliary carcinoma and colorectal cancer (NCT03225989); LOAd703 in combination with gemcitabine and nab-paclitaxel in patients with pancreatic cancer (NCT02705196); the oncolytic adenovirus encoding human PH20 hyaluronidase (VCN-01) has been used in combination with gemcitabine and Abraxane® in patients with advanced solid tumors, including pancreatic adenocarcinoma (NCT02045602;

NCT02045589); Telomelysin® (OBP-301), an oncolytic Ad with tumor selectivity, containing the human telomerase reverse transcriptase (hTERT) promoter, in patients with hepatocellular carcinoma (NCT02293850); an E1B gene deleted Ad5 in combination with transarterial chemoembolization (TACE) in patients with hepatocellular carcinoma (NCT01869088); CG0070, an oncolytic Ad that expresses GM-CSF and contains the cancer-specific E2F-1 promoter to drive expression of EIA, in patients with bladder cancer (NCT02365818; NCT01438112); Enadenotucirev (ColoAd1), an Ad11p/Ad3 chimeric Group B oncolytic virus, in patients with colon cancer, non-small cell lung cancer, bladder cancer and renal cell carcinoma (NCT02053220); and DNX-2401 (Ad5 E1AA24RGD) in combination with Temozolomide (NCT01956734), or in combination with IFNγ (NCT02197169) in patients with glioblastoma. CAR-T cells often can be marginally effective as therapeutic agents, particularly against solid tumors, due to factors such as insufficient T-cell migration and the immunosuppressive milieu of solid tumors. It was found that in a neuroblastoma tumor model in mice, combination therapy using CAR-T cells together with an oncolytic Ad virus, Ad5424, which was armed with the chemokine RANTES and the cytokine IL-15, increased migration and survival of the CAR-T cells to the tumor site. The adenovirus had a potent, dose-dependent cytotoxic effect on tumor cells and accelerated caspase pathways in tumor cells exposed to CAR-T cells, without damaging the CAR-T cells (Nishio et al., *Cancer Res.,* 74 (18): 5195-5205 (2014)). In addition, the intratumoral release of RANTES and IL-15 attracted CAR-T cells to the tumor site and promoted their local survival, respectively, thereby increasing the overall survival of the tumor-bearing mice compared to treatment with CAR-T alone (Nishio et al., *Cancer Res.,* 74 (18): 5195-5205 (2014)).

As with other oncolytic viruses, Ads suffer from a low therapeutic efficacy when systemically administered due to the development of neutralizing antibodies, and due to their high seroprevalence, it is estimated that as much as 90% of some populations possess prior immunity to Ads (Uusi-Kerttula et al. (2015) Viruses 7:6009-6042). Additionally, nonspecific liver sequestration of the Ads results in hepatotoxicity (Choi et al. (2015)). Polymers, such as PEG, positively charged arginine-grafted bioreducible polymer (ABP), PAMAMG5, and other nanomaterials can be used to mask the viral capsid protein, mitigating the anti-viral immune response and nonspecific liver accumulation, and increasing tumor accumulation (Choi et al. (2015)). Other approaches to evade the immune system involve the use of carrier vehicle cells to deliver oncolytic Ads. For example, T-cells were used to deliver Delta24-RGD Ad to glioblastoma cells in vitro and in vivo in an orthotopic glioma stem cell (GSC)-based xenograft murine model (Balvers et al. (2014) Viruses 6:3080-3096). Systemic administration of virus-loaded T-cells resulted in intratumoral viral delivery (Balvers et al. (2014)). Clinical trials investigating the delivery of Ad with carrier/vehicle cells include the use of neural stem cells loaded with oncolytic Ad for the treatment of malignant gliomas (NCT03072134); autologous dendritic cells infected with Ad expressing Her2 in patients with metastatic breast cancer (NCT00197522); and autologous mesenchymal stem cells (MSCs) infected with ICOVIR5 in children and adults with metastatic and refractory solid tumors (NCT01844661).

Poliovirus

Poliovirus (PV) belongs to the genus *Enterovirus* in the family Picornaviridae and has a positive-sense single-stranded RNA genome. PV infection results in severe neurological syndrome poliomyelitis, due to the tropism of PV for spinal cord and motor neurons (Brown and Gromeier (2015) *Discov. Med.* 19 (106): 359-365). PVs are useful in clinical application due to their retention of a robust replicative capacity and cytotoxicity in the presence of an active antiviral IFN response, allowing for several rounds of viral replication to amplify the immune-stimulating viral cytotoxic effects (Brown and Gromeier (2015) *Discov. Med.* 19 (106): 359-365). PVs also do not integrate into the host cell genome (Yla-Pelto et al. (2016) *Viruses* 8, 57).

PV host cell entry is mediated by the Ig-superfamily cell adhesion molecule CD155, also known as PV receptor (PVR) and Nectin-like molecule 5 (Nec15), which is widely overexpressed in solid neoplasias, such as glioblastoma (Brown and Gromeier (2015) *Curr. Opin. Virol.* 13:81-85). CD155 also is expressed in colorectal carcinoma, lung adenocarcinoma, breast cancers and melanoma, and is expressed in antigen presenting cells (APCs) such as macrophages and dendritic cells (Brown et al. (2014) *Cancer* 120 (21): 3277-3286).

The internal ribosomal entry site (IRES) of PV is responsible for driving translation initiation of the PV RNA genome, and is implicated in the neuropathogenicity of PV. The live-attenuated PV vaccines, which are derived from the Sabin serotypes, carry critical attenuating point mutations in the IRES (Brown and Gromeier (2015) *Curr. Opin. Virol.* 13:81-85). The highly attenuated polio-/rhinovirus recombinant PVSRIPO, a type 1 (Sabin) live-attenuated PV vaccine in which the cognate PV IRES is replaced with that of the human rhinovirus 2 (HRV2), exhibits no neurovirulence/neuropathogenicity in comparison to the parent PV, but retains cancer cell cytotoxicity and specificity towards GBM cells. (Brown and Gromeier (2015) *Curr. Opin. Virol.* 13:81-85; Brown and Gromeier (2015) *Discov. Med.* 19 (106): 359-365). PVSRIPO causes tumor regression by eliciting an antitumor immune response, rather than the direct lysis of bulk tumor, and has been used for the treatment of recurrent glioblastoma (GBM) (NCT01491893) (Brown and Gromeier (2015) Curr. Opin. Virol. 13:81-85; Brown and Gromeier (2015) *Discov. Med.* 19 (106): 359-365). A Phase 1b clinical trial has investigated the use of PVSRIPO for treatment of recurrent malignant glioma in children (NCT03043391), and a Phase 2 clinical trial has investigated the use of PVSRIPO alone, and in combination with the chemotherapy drug lomustine in adult patients with recurrent malignant glioma (NCT02986178).

Herpes Simplex Virus

Herpes simplex virus (HSV) belongs to the family Herpesviridae and has a large linear double-stranded DNA genome, including many genes that are nonessential for viral replication, making it an ideal candidate for genetic manipulation. Other advantages include its ability to infect a broad range of cell types, its sensitivity to antivirals such as aciclovir and ganciclovir, and its lack of insertional mutagenesis (Sokolowski et al. (2015) *Oncolytic Virotherapy* 4:207-219; Yin et al. (2017) *Front. Oncol.* 7:136). There are two types of HSV, HSV type I (HSV-1) and type II (HSV-2), with the majority of oncolytic HSVs being derived from HSV-1. In humans, HSV-1 causes fever blister disease and infects epithelial cells, neurons, and immune cells by binding to nectins, glycoproteins, and the herpesvirus entry mediator (HVEM) on the cell surface (Kohlhapp and Kaufman (2016) Clin. Cancer Res. 22 (5): 1048-1054).

Many different oncolytic HSV-1 viruses have been generated to date. For example, HSV-1 has been engineered to express the anti-HER-2 antibody trastuzumab, targeting tumors that overexpress HER-2, such as breast and ovarian cancers, gastric carcinomas and glioblastomas. The gene encoding trastuzumab was inserted into two regions within the HSV-1 gD glycoprotein gene, generating two oncolytic HSVs, R-LM113 and R-LM249. R-LM113 and R-LM249 demonstrated preclinical activity against human breast and ovarian cancers, and against a murine model of HER2+ glioblastoma. R-LM249 has been administered systemically using mesenchymal stromal cells (MSCs) as carrier cells, exerting therapeutic effects against lung and brain metastases of ovarian and breast cancer in a murine model (Campadelli-Fiume et al. (2016) Viruses 8, 63). Another oncolytic HSV-1, dlsptk HSV-1, contains a deletion in the unique long 23 (UL23) gene, which encodes the viral homologue of thymidine kinase (TK), while the hrR3 HSV-1 mutant contains a LacZ insertion mutation of the large subunit of ribonucleotide reductase (RR), also known as ICP6, encoded by the gene UL39. As a result, dlsptk and hrR3 HSV-1 mutants can only replicate in cancer cells that overexpress TK and RR, respectively (Sokolowski et al. (2015) *Oncolytic Virotherapy* 4:207-219).

HF10 is a spontaneously mutated oncolytic HSV-1 that lacks the genes encoding UL43, UL49.5, UL55, UL56 and latency-associated transcripts, and overexpresses UL53 and UL54. HF10 has demonstrated high tumor selectivity, high viral replication, potent antitumor activity and a favorable safety profile (Eissa et al. (2017) *Front. Oncol.* 7:149). Clinical trials investigating HF10 include: a phase I study in patients with refractory head and neck cancer, squamous cell carcinoma of the skin, carcinoma of the breast and malignant melanoma (NCT01017185) and a Phase I study of HF10 in combination with chemotherapy (gemcitabine, Nab-paclitaxel, TS-1) in patients with unresectable pancreatic cancer (NCT03252808). HF10 also has been combined with the anti-CTLA-4 antibody ipilimumab, resulting in improved therapeutic efficacy in patients with stage IIIb, IIIc or IV unresectable or metastatic melanoma (NCT03153085). A phase II clinical study has investigated the combination of HF10 with the anti-PD-1 antibody Nivolumab in patients with resectable stage IIIb, IIIc and IV melanoma (NCT03259425) and in combination with ipilimumab in patients with unresectable or metastatic melanoma (NCT02272855). Paclitaxel and HF10 combination therapy resulted in superior survival rates in peritoneal colorectal cancer models compared with either treatment alone, while combination treatment with HF10 and erlotinib resulted in improved activity against pancreatic xenografts in vitro and in vivo than either HF10 or erlotinib alone (Eissa et al. (2017) *Front. Oncol.* 7:149).

Talimogene laherparepvec (Imlygic®, T-VEC), previously known as OncoVEX$^{GM\text{-}CSF}$ is an FDA-approved oncolytic herpes simplex virus for the treatment of advanced melanoma, that was generated from the JS1 strain of HSV-1 and genetically engineered to express granulocyte macrophage stimulating factor (GM-CSF) (Aref et al. (2016) *Viruses* 8:294). In T-VEC, GM-CSF expression enhances the antitumor cytotoxic immune response, while deletion of both copies of the infected cell protein 34.5 (ICP34.5) gene suppresses replication in normal tissues, and deletion of the ICP47 gene increases expression of MHC class I molecules, allowing for antigen presentation on infected cells (Eissa et al. (2017)). T-VEC exhibits tumor selectivity by binding to nectins on the surface of cancer cells and preferentially replicates in tumor cells by exploiting disrupted oncogenic and antiviral signaling pathways, particularly the protein kinase R (PKR) and type I IFN pathways. In normal cells, PKR is activated by viral infection, which then phosphorylates the eukaryotic initiation factor-2A protein (eIF-2A), inactivating it and in turn, inhibiting cellular protein synthesis, blocking cell proliferation and preventing viral replication. Wild-type HSV escapes the antiviral response due to expression of the ICP34.5 protein, which activates a phosphatase that dephosphorylates eIF-2A, restoring protein synthesis in the infected cells. Thus, deletion of ICP34.5 precludes viral replication of T-VEC in normal cells. The PKR-eIF-2A pathway in cancer cells, however, is disrupted, permitting continuous cell growth and uninhibited viral replication (Kohlhapp and Kaufman (2016) Clin. Cancer Res. 22 (5): 1048-1054; Yin et al. (2017) *Front. Oncol.* 7:136). The expression of GM-CSF improves the immunogenicity of T-VEC by causing dendritic cell accumulation, promoting antigen-presentation and priming T-cell responses (Kohlhapp and Kaufman (2016) *Clin. Cancer Res.* 22 (5): 1048-1054).

T-VEC has shown preferential replication in a variety of different cancer cell lines, including breast cancer, colorectal adenocarcinoma, melanoma, prostate cancer, and glioblastoma. Clinical trials include, for example, those investigating T-VEC in pancreatic cancer (NCT03086642, NCT00402025), recurrent breast cancer (NCT02658812), advanced non-CNS tumors in children (NCT02756845), non-melanoma skin cancer (NCT03458117), non-muscle invasive bladder transitional cell carcinoma (NCT03430687), and malignant melanoma (NCT03064763), as well as T-VEC in combination with atezolizumab in patients with metastatic triple negative breast cancer and metastatic colorectal cancer with liver metastases (NCT03256344), in combination with paclitaxel in patients with triple negative breast cancer (NCT02779855), in combination with nivolumab in patients with refractory lymphomas or advanced/refractory non-melanoma skin cancers (NCT02978625), in combination with cisplatin and radiotherapy in patients with advanced head and neck cancer (NCT01161498), and in combination with pembrolizumab in patients with liver tumors (NCT02509507), carcinoma of the head and neck (NCT02626000), sarcoma (NCT03069378) and melanoma (NCT02965716, NCT02263508).

In addition to GM-CSF, numerous other immune stimulating genes have been inserted into oncolytic HSVs, including those encoding IL-12, IL-15, IL-18, TNFα, IFNα/β and fms-like tyrosine kinase 3 ligand, resulting in increased therapeutic efficacy (Sokolowski et al. (2015); Yin et al. (2017)).

Another oncolytic HSV-1, R3616 contains deletions in both copies of the RL1 (also known as γ134.5) gene, which encodes ICP34.5, targeting cancer cells with disrupted PKR pathways. NV1020 (or R7020) is an HSV-1 mutant that contains deletions in the UL55, UL56, ICP4, RL1 and RL2 genes, resulting in reduced neurovirulence and cancer selectivity. NV1020 has shown results in murine models of head and neck squamous cell carcinoma, epidermoid carcinoma and prostrate adenocarcinoma (Sokolowski et al. (2015)). NV1020 has been investigated for treatment of colorectal cancer metastatic to the liver (NCT00149396 and NCT00012155).

G207 (or MGH-1) is another HSV-1 mutant with an RL1 (Y134.5) deletion and a LacZ inactivating insertion in the UL39 neurovirulence gene. Clinical studies using G207 include the investigation of G207 administration alone or with a single radiation dose in children with progressive or recurrent supratentorial brain tumors (NCT02457845), the investigation of the safety and efficacy of G207 in patients with recurrent brain cancer (glioma, astrocytoma, glioblastoma) (NCT00028158), and the investigation of the effects of G207 administration followed by radiation therapy in patients with malignant glioma (NCT00157703).

G207 was used to generate G474, which contains a further deletion in the gene encoding ICP47. Other HSV-1 derived oncolytic viruses include HSV1716, which contains deletions in RL1, but has an intact UL39 gene and replicates selectively in actively dividing cells, and the KM100 mutant, which has insertions in the UL48 and RL2 genes, resulting in a loss of expression of immediate early viral genes and cancer cell selectivity (Sokolowski et al. (2015); Yin et al. (2017) *Front. Oncol.* 7:136).

Since the majority of the population possesses preexisting immunity to HSV-1, the use of carrier cells to deliver oncolytic HSVs can improve their therapeutic potential. For example, human peritoneal mesothelial cells (MCs) were used as carrier cells for HF10, leading to the efficient killing of ovarian cancer cells in vitro, as well as in a mouse xenograft model of ovarian cancer (Fujiwara et al. (2011) *Cancer Gene Therapy* 18:77-86).

Oncolytic viruses also have been derived from HSV-2. For example, FusOn-H2 is an HSV-2 oncolytic virus with a deletion of the N-terminal region of the ICP10 gene that encodes a serine/threonine protein kinase (PK) domain. This PK is responsible for phosphorylating GTPase-activating protein Ras-FAP, which activates the Ras/MEK/MAPK mitogenic pathway and induces and stabilizes c-Fos, which is required for efficient HSV-2 replication. Normal cells usually have an inactivated Ras signaling pathway. Thus, FusOn-H2 exhibits tumor selectivity by replicating only in tumor cells with activated Ras signaling pathways (Fu et al. (2006) *Clin. Cancer Res.* 12 (10): 3152-3157). FusOn-H2 has demonstrated activity against pancreatic cancer xenografts (Fu et al. (2006) Clin. Cancer Res. 12 (10): 3152-3157), against Lewis lung carcinoma xenografts in combination with cyclophosphamide, and against syngeneic murine mammary tumors and neuroblastoma (Li et al. (2007) Cancer Res. 67:7850-7855).

Poxvirus

Vaccinia Virus

Examples of vaccinia viruses include, but are not limited to, Lister (also known as Elstree), New York City Board of Health (NYCBH), Dairen, Ikeda, LC16M8, Western Reserve (WR), Copenhagen (Cop), Tashkent, Tian Tan, Wyeth, Dryvax, IHD-J, IHD-W, Brighton, Ankara, Modified Vaccinia Ankara (MVA), Dairen I, LIPV, LC16M0, LIVP, WR 65-16, EM63, Bern, Paris, CVA382, NYVAC, ACAM2000, ACAM1000 and Connaught strains. Vaccinia viruses are oncolytic viruses that possess a variety of features that make them particularly suitable for use in wound and cancer gene therapy. For example, vaccinia is a cytoplasmic virus, thus, it does not insert its genome into the host genome during its life cycle. Unlike many other viruses that require the host's transcription machinery, vaccinia virus can support its own gene expression in the host cell cytoplasm using enzymes encoded in the viral genome. Vaccinia viruses also have a broad host and cell type range. In particular, vaccinia viruses can accumulate in immunoprivileged cells or immunoprivileged tissues, including tumors and/or metastases, and also including wounded tissues and cells. Yet, unlike other oncolytic viruses, vaccinia virus can typically be cleared from the subject to whom the viruses are administered by activity of the subject's immune system, and hence are less toxic than other viruses such as adenoviruses. Thus, while the viruses can typically be cleared from the subject to whom the viruses are administered by activity of the subject's immune system, viruses can nevertheless accumulate, survive and proliferate in immunoprivileged cells and tissues such as tumors, because such immunoprivileged areas are isolated from the host's immune system.

Vaccinia viruses also can be easily modified by insertion of heterologous genes. This can result in the attenuation of the virus and/or permit delivery of therapeutic proteins. For example, the vaccinia virus genome has a large carrying capacity for foreign genes, where up to 25 kb of exogenous DNA fragments (approximately 12% of the vaccinia genome size) can be inserted. The genomes of several of the vaccinia strains have been completely sequenced, and many essential and nonessential genes identified. Due to high sequence homology among different strains, genomic information from one vaccinia strain can be used for designing and generating modified viruses in other strains. Finally, the techniques for production of modified vaccinia strains by genetic engineering are well established (Moss (1993) *Curr. Opin. Genet. Dev.* 3:86-90; Broder and Earl, (1999) *Mol. Biotechnol.* 13:223-245; Timiryasova et al. (2001) *Biotechniques* 31:534-540).

Various vaccinia viruses have been demonstrated to exhibit antitumor activities. In one study, for example, nude mice bearing non-metastatic colon adenocarcinoma cells were systemically injected with a WR strain of vaccinia virus modified by having a vaccinia growth factor deletion and an enhanced green fluorescence protein inserted into the thymidine kinase locus. The virus was observed to have antitumor effects, including one complete response, despite a lack of exogenous therapeutic genes in the modified virus (McCart et al. (2001) Cancer Res. 1:8751-8757). In another study, vaccinia melanoma oncolysate (VMO) was injected into sites near melanoma positive lymph nodes in a Phase III clinical trial of melanoma patients. As a control, a New York City Board of Health strain vaccinia virus (VV) was administered to melanoma patients. The melanoma patients treated with VMO had a survival rate better than that for untreated patients, but similar to patients treated with the VV control (Kim et al. (2001) Surgical Oncol. 10:53-59).

LIVP strains of vaccinia virus also have been used for the diagnosis and therapy of tumors, and for the treatment of wounded and inflamed tissues and cells (see e.g., Zhang et al. (2007) *Surgery* 142:976-983; Lin et al. (2008) *J. Clin. Endocrinol. Metab.* 93:4403-7; Kelly et al. (2008) *Hum. Gene Ther.* 19:774-782; Yu et al. (2009) *Mol. Cancer Ther.* 8:141-151; Yu et al. (2009) *Mol. Cancer* 8:45; U.S. U.S. Pat. Nos. 7,588,767; 8,052,968; and U.S. Publication No. 2004/0234455). For example, when intravenously administered, LIVP strains have been demonstrated to accumulate in internal tumors at various loci in vivo, and have been demonstrated to effectively treat human tumors of various tissue origin, including, but not limited to, breast tumors, thyroid tumors, pancreatic tumors, metastatic tumors of pleural mesothelioma, squamous cell carcinoma, lung carcinoma and ovarian tumors. LIVP strains of vaccinia, including attenuated forms thereof, exhibit less toxicity than WR strains of vaccinia virus, and result in increased and longer survival of treated tumor-bearing animal models (see, e.g., U.S. Publication No. 2011/0293527). Wyeth strains of vaccinia virus, such as JX-594, also exhibit lower toxicity, and have been used for the treatment of cancers.

Vaccinia is a cytoplasmic virus, thus, it does not insert its genome into the host genome during its life cycle. Vaccinia virus has a linear, double-stranded DNA genome of approximately 180,000 base pairs in length that is made up of a single continuous polynucleotide chain (Baroudy et al. (1982) *Cell* 28:315-324). The structure is due to the presence of 10,000 base pair inverted terminal repeats (ITRs). The ITRs are involved in genome replication. Genome replication involves self-priming, leading to the formation of high molecular weight concatemers (isolated from infected cells) which are subsequently cleaved and repaired to make virus genomes (see, e.g., Traktman, P., Chapter 27, Poxvirus DNA Replication, pp. 775-798, in DNA Replication in Eukaryotic Cells, Cold Spring Harbor Laboratory Press (1996)). The genome contains approximately 250 genes. In general, the non-segmented, non-infectious genome is arranged such that centrally located genes are essential for virus replication (and are thus conserved), while genes near the two termini effect more peripheral functions such as host range and virulence. Vaccinia viruses practice differential gene expression by using open reading frames (ORFs) arranged in sets that, as a general principle, do not overlap.

Vaccinia virus possesses a variety of features for use in cancer gene therapy and vaccination including broad host and cell type range, and low toxicity. For example, while most oncolytic viruses are natural pathogens, vaccinia virus has a unique history in its widespread application as a smallpox vaccine that has resulted in an established track record of safety in humans. Toxicities related to vaccinia administration occur in less than 0.1% of cases, and can be effectively addressed with immunoglobulin administration. In addition, vaccinia virus possesses a large carrying capacity for foreign genes (up to 25 kb of exogenous DNA fragments, approximately 12% of the vaccinia genome size, can be inserted into the vaccinia genome) and high sequence homology among different strains for designing and generating modified viruses in other strains. Techniques for production of modified vaccinia strains by genetic engineering are well established (Moss (1993) *Curr. Opin. Genet. Dev.* 3:86-90; Broder and Earl (1999) *Mol. Biotechnol.* 13:223-245; Timiryasova et al. (2001) *Biotechniques* 31:534-540). Vaccinia virus strains have been shown to specifically colonize solid tumors, while not infecting other organs (see, e.g., Zhang et al. (2007) *Cancer Res.* 67:10038-10046; Yu et al. (2004) *Nat. Biotech.* 22:313-320; Heo et al. (2011) *Mol. Ther.* 19:1170-1179; Liu et al. (2008) *Mol. Ther.* 16:1637-1642; Park et al. (2008) *Lancet Oncol.* 9:533-542).

ACAM2000

In exemplary embodiments, a vaccinia virus for use in a CAVES system provided herein and used in related methods is the ACAM2000 vaccinia virus strain, a clone isolated Dryvax vaccine licensed in the USA. ACAM2000 has the sequence set forth in SEQ ID NO:70. After propagating it, the ACAM2000 has the sequence set forth in SEQ ID NO:71 (designated herein as “CAL1” or “WT1”), which is a variant of SEQ ID NO:70 that includes the left ITR shorter by 6 bases, the right ITR being shorter by 197 bases, and a single SNP at position 32 (a non-coding region and part of the ITR sequence). An exemplary CAVES system that contains vaccinia virus, contains ACAM2000 or CALL or modified strains thereof as the oncolytic virus, and a stem cell such as, but not limited to, a mesenchymal stem cell, adipose stromal cells, fibroblasts, and a subpopulation of adipose stromal cells, such as supra adventitial-adipose stromal cells (SA-ASC; CD235a−/CD45−/CD34+/CD146−/CD31−) or pericytes (CD235a−/CD45−/CD34−/CD146+/CD31−).

In embodiments, the ACAM2000 virus or CAL1 virus is modified for attenuation e.g., to render it safer for systemic administration, such as attenuation of the F1L and/or B8R loci, and/or to express a therapeutic gene and/or a marker, such as a selection marker.

Coxsackie Virus

Coxsackie virus (CV) belongs to the genus Enterovirus and the family Picornaviridae and has a positive-sense single-stranded RNA genome that does not integrate into the host cell genome. CVs are classified into groups A and B, based on their effects in mice, and can cause mild upper respiratory tract infections in humans (Bradley et al. (2014) Oncolytic Virotherapy 3:47-55). Coxsackie viruses for oncolytic virotherapy include, but are not limited to, attenuated coxsackie virus B3 (CV-B3), CV-B4, CV-A9 and CV-A21 (Yla-Pelto et al. (2016) Viruses 8, 57). CV-A21 infects cells via the ICAM-1 (or CD54) and DAF (or CD55) receptors, which are expressed at much higher levels in tumor cells, including melanoma, breast, colon, endometrial, head and neck, pancreatic and lung cancers, as well as in multiple myeloma and malignant glioma. CV-A21 has shown preclinical anticancer activity in vitro against malignant myeloma, melanoma, prostate, lung, head and neck, and breast cancer cells lines, and in vivo in mice bearing human melanoma xenografts, and against primary breast cancer tumors as well as their metastases in mice (Yla-Pelto et al. (2016); Bradley et al. (2014)). A derivative of CV-A21, CV-A21-DAFv, also known as CAVATAK™, was generated from the wildtype Kuykendall strain by serial passage of CV-A21 on DAF-expressing, ICAM-1-negative rhabdomyosarcoma (RD) cells and has enhanced oncolytic properties in comparison to the parent strain. CAVATAK™ binds only to the DAF receptor, which can contribute to its enhanced tropism towards cancer cells (Yla-Pelto et al. (2016)).

CV-A21 also has been studied in combination with doxorubicin hydrochloride, exhibiting enhanced oncolytic efficiency compared to either treatment alone against human breast, colorectal and pancreatic cancer cell lines, as well as in a xenograft mouse model of human breast cancer (Yla-Pelto et al. (2016)). Since a significant portion of the population has already developed neutralizing antibodies against CV, CV-A21 therapy has been combined with immunosuppressants such as cyclophosphamide (Bradley et al. (2014)) and can be used for delivery via vehicle cells as described herein.

Clinical trials have investigated the use of the virus designated CAVATAK™ virus in patients with stage IIIc or IV malignant melanoma (NCT01636882; NCT00438009; NCT01227551), and CAVATAK™ alone or in combination with low dose mitomycin C in patients with non-muscle invasive bladder cancer (NCT02316171). Clinical trials also have studied the effects of intravenous administration of CV-A21 in the treatment of solid tumors including melanoma, breast and prostate cancer (NCT00636558). CAVATAK™ alone or in combination with pembrolizumab for treatment of patients with non-small cell lung cancer (NCT02824965, NCT02043665) and bladder cancer (NCT02043665) also has been in clinical trials, as has CAVATAK™ virus in combination with ipilimumab in patients with uveal melanoma and liver metastases (NCT03408587) and in patients with advanced melanoma (NCT02307149); and as has CAVATAK™ virus in combination with pembrolizumab in patients with advanced melanoma (NCT02565992).

Seneca Valley Virus

Seneca Valley Virus (SVV) is a member of the Senecavirus genus within the family Picornaviridae, that has a positive-sense single-stranded RNA genome and is selective for neuroendocrine cancers including neuroblastoma, rhabdomyosarcoma, medulloblastoma, Wilms tumor, glioblastoma and small-cell lung cancer (Miles et al. (2017) *J. Clin. Invest.* 127 (8): 2957-2967; Qian et al. (2017) *J. Virol.* 91 (16): e00823-17; Burke, M. J. (2016) *Oncolytic Virotherapy* 5:81-89). Studies have identified the anthrax toxin receptor 1 (ANTXR1) as the receptor for SVV, which is frequently expressed on the surface of tumor cells in comparison to normal cells, but prior studies also have indicated that sialic acid can be a component of the SVV receptor in pediatric glioma models (Miles et al. (2017)). SVV isolate 001 (SVV-001) is a potent oncolytic virus that can target and penetrate solid tumors following intravenous administration and is attractive due to its lack of insertional mutagenesis as well as its selective tropism for cancer cells and its non-pathogenicity in humans and animals. Additionally, previous exposure in humans is rare, resulting in low rates of preexisting immunity (Burke, M. J. (2016) *Oncolytic Virotherapy* 5:81-89).

SVV-001 has shown in vitro activity against small-cell lung cancer, adrenal gland cortical carcinoma, neuroblastoma, rhabdomyosarcoma, and Ewing sarcoma cell lines, and in vivo activity in orthotopic xenograft mouse models of pediatric GBM, medulloblastoma, retinoblastoma, rhabdomyosarcoma and neuroblastoma (Burke (2016)). NTX-010, an oncolytic SVV-001 developed by Neotropix®, has proven feasible and tolerable for the treatment of pediatric patients with relapsed/refractory solid tumors alone or in combination with cyclophosphamide, but was limited in its therapeutic efficacy due to the development of neutralizing antibodies (Burke et al. (2015) *Pediatr. Blood Cancer* 62 (5): 743-750). Clinical trials include studies using SV-001 in patients with solid tumors with neuroendocrine features (NCT00314925), NTX-010/SVV-001 in combination with cyclophosphamide in patients with relapsed or refractory neuroblastoma, rhabdomyosarcoma, Wilms tumor, retinoblastoma, adrenocortical carcinoma or carcinoid tumors (NCT01048892), and NTX-010/SVV-001 in patients with small cell lung cancer after chemotherapy (NCT01017601).

Methods of Modifying Viruses

A number of methods of engineering viruses, which includes methods for engineering cell vehicles such as those described above, are known in the art. Techniques for production of modified Vaccinia strains by genetic engineering are well established (Moss, Curr. Opin. Genet. Dev. 3 (1993), 86-90; Broder and Earl, *Mol. Biotechnol.* 13 (1999), 223-245; Timiryasova et al., *Biotechniques* 31 (2001), 534-540). Methods for engineering oncolytic viruses include, but are not limited to:

(1) Homologous recombination requires the use of a donor vector, containing transgene flanked by two DNA areas homologous to the recipient viral DNA in the location where we want to insert the transgene (Kaufman, H.L., F.J. Kohlhapp, and A. Zloza, Oncolytic viruses: a new class of immunotherapy drugs. *Nat Rev Drug Discov,* (2015) 14 (9): 642-62). Recombinant viruses can be then selected by several approaches, including TK-positive/negative, beta-galactosidase, dominant selective markers such as green fluorescent protein (GFP or eGFP), blue fluorescent protein (BFP) or TurboFP635, or with transient dominant selection (TDS) with phosphoribosyltransferase (gpt).

The CRE/lox system, derived from P1 bacteriophage, is a site-specific recombinase technology used to carry out deletions, insertions, translocations, and inversions at specific sites in the DNA of cells (Kleinstiver, B. P., et al., High-fidelity CRISPR-Cas9 nucleases with no detectable genome-wide off-target effects. *Nature* 529 (7587): 490-495 (2016)). This tool works both in eukaryotic and prokaryotic organisms and has been well established, creating a variety of transgenic animal models (Ran, F. A., et al., Double nicking by RNA-guided CRISPR Cas9 for enhanced genome editing specificity. Cell, 2013. 154 (6): p. 1380-9). This system is based on a site-specific Cre recombinase (~1 kb) that requires a 34 bp specific loxP sequences which are easy to incorporate into any target DNA. One of the advantages of the Cre/lox recombination system is that there is no need for additional cofactors or sequence elements for efficient recombination regardless of the cellular environment (Schaefer, K. A., et al., Unexpected mutations after CRISPR-Cas9 editing in vivo. *Nat Methods,* 2017. 14 (6): p. 547-548). Analysis showed that the mutations of loxP sequence such as m2, m3, m7, m11, and lox5171 recombine readily with themselves but have a markedly low recombination with the wild-type site. Therefore, those sequences can be used for gene insertion via recombinase-mediated cassette exchange (RMCE) with high efficiency fidelity and in a site-specific manner (Oberstein, A., et al., Site-specific transgenesis by Cre-mediated recombination in *Drosophila. Nat Methods,* (2005) 2 (8): 583-5). Nakano and colleagues demonstrated the RMCE can be used to produce adenovirus vectors by the replacement of a specific gene in the replicating adenovirus genome with a gene of interest using a nuclear Cre recombinase and incompatible loxP and loxP 2272 system (Kuhn, R. and R.M. Torres, Cre/loxP recombination system and gene targeting. *Methods Mol Biol,* 2002. 180: p. 175-204).

(2) CRISPR/Cas9 has been used to generate new recombinant Vaccinia viruses. CRISPR/Cas9 has recently emerged as a method to edit genomes from various organisms due to the ability of Cas9 protease to cut at a defined site in DNA genomes marked by a signal guide RNA (Wyatt, L. S., P. L. Earl, and B. Moss, Generation of Recombinant 1982 Viruses. *Curr Protoc Mol Biol,* 2017. 117: p. 16.17.1-16.17.18). Introduction of a double-strand break by Cas9 in the target DNA facilitates insertion of the desired gene. Yuan and colleagues showed improved efficiency in the generation of new recombinant virus (more than 50 times) by using CRISPR/cas9 system as compared to with homologous recombination approach (Falkner, F. G. and B. Moss, Transient dominant selection of recombinant vaccinia viruses. *J Virol,* 1990. 64 (6): p. 3108-11). To overcome off-target-induced mutations in mammalian cells, several mutations in Cas9 nuclease have been introduced: N497A, R661A, Q695A, and Q926A (Cas9 high fidelity) resulting in a more precise cut (Mali, P., K. M. Esvelt, and G. M. Church, Cas9 as a versatile tool for engineering biology. *Nat Methods,* 2013. 10 (10): p. 957-63) or D10A mutated Cas9, which provides a single-stranded break (Yuan, M., et al., A Simple and Efficient Approach to Construct Mutant Vaccinia Virus Vectors. J Vis Exp, 2016 (116)).

Engineered Viruses

In embodiments, the CAVES systems provided herein can be generated using engineered oncolytic viruses. The oncolytic viruses can be engineered by methods known in the art or as provided herein. The viruses can be engineered for recombinant expression of selection markers including, but not limited to, EGFP, EmGFP, mNeonGreen, EBFP, TagBFP, EYFP, TPet, GFP, BFP or TurboFP635, and/or for recombinant expression of a therapeutic protein including, but not limited to, cytokines (GM-CSF, IL-2, IL-10, IL-12, IL-15, IL-17, IL-18, IL-21, TNF, MIPla, FLt3L, IFN-b, IFN-g), chemokines (CC15, CC12, CC119, CXC111, RANTES) co-stimulators (OX40L, 41BBL, CD40L, B7.1/CD80, GITRL, LIGHT, CD70), BITEs, therapeutic antibodies, immune checkpoint inhibitors, single chain antibodies against e.g., VEGF, e.g., VEGFA, VEGFB, PGF, VEGFR2, PDGFR, Ang-1, Ang-2, ANGPT1, ANGPT2, HGF and immune checkpoint inhibitors, e.g., against PD-1, PD-L1, CTLA4, TIM-3, prodrug activators (lacZ, cytosine deaminase enzymes), human sodium iodide symporter-hNIS and Aquaporin 1-AQP1. The viruses can be engineered to express 1, 2 or more of the recombinant proteins described above under different viral promoters (e.g., Pel, pL). The viruses can be engineered to express combinations of therapeutic proteins, e.g., against modulators of angiogenesis and immune system co-stimulators or checkpoints, e.g., anti-VEGFA and VEGFB and PGF; anti-VEGF and anti-ANGPT2; anti-VEGF, anti-ANGPT-2 and anti-CTL4; anti-VEGF and OX40L; anti-VEGF, anti-ANGPT2 and anti-PD-1.

Engineered Vaccinia Virus

In embodiments, the engineered viruses are engineered Vaccinia virus. In embodiments, the Vaccinia virus is ACAM2000 and derivatives thereof, such as those produced by propagating the virus. In embodiments, the Vaccinia virus has a genome that comprises the sequence set forth in SEQ ID NO: 70 (ACAM2000) or SEQ ID NO: 71 (CAL1). Sequencing analysis of the ACAM2000 genomic DNA has identified 241 different open reading frames (ORF) encoding viral structures, enzymes, immunomodulator proteins, and proteins with unidentified functions. In certain embodiments, selection markers and/or therapeutic genes can be inserted into non-essential loci, well known to those of skill in the art. In some embodiments, insertion is effected into the intergenic region between ORF_157 and ORF_158, without changing the original properties of the virus. Other loci such as the intergenic area of OFR 174 and ORF_175, or truncated ORFs (72, 73, 156, 157, 157, 159, 160, 174, 175, e.g.) also can be employed for inserting transgenes without changing the original virus properties. The viruses can be further attenuated viruses by inactivation of genes such as Thymidine kinase (TK), hemagglutinin (HA), interferon alfa/beta blocker receptors, and other immunomodulators. In embodiments, the FIL locus or portion thereof can be replaced with or interrupted with a selection or a detectable marker and/or therapeutic gene of interest (i.e., eliminating FIL function, which is a potent inhibitor of intrinsic mitochondrial apoptosis). In other embodiments, the anti-interferon gamma gene B8R or portion thereof is replaced with a selection marker and/or therapeutic gene of interest. The attenuated viruses, in addition to being vehicles for carrying exogenous genes, such as therapeutic genes, can sometimes be safer for systemic administration.

In some embodiments, the Vaccinia or ACAM2000 is modified for enhanced EEV (extracellular enveloped virus) production. In one embodiment, enhanced EEV production is achieved by substituting glycine with glutamic acid at amino acid 151 of the A34R protein (K151E). Vaccinia virus produces four different types of virions from each infected cell called intracellular mature virus (IMV), intracellular enveloped virus (IEV), cell-associated enveloped virus (CEV) and extracellular enveloped virus (EEV). The EEV is optimized for rapid and efficient spread through solid tumors locally and to regional or distant tumor sites. The K151E mutation increases EEV release while maintaining infectivity of the released viruses.

Provided herein are modified ACAM2000 viruses containing one or more of the aforementioned modifications in an unmodified ACAM2000 virus and/or other modifications known to those of skill in the art. One or more of any of the therapeutic genes and/or selection markers described herein and/or known to those of skill in the art can be introduced to generate the engineered ACAM2000 viruses provided herein. In embodiments, the unmodified ACAM2000 virus has the sequence set forth in SEQ ID NO: 70. In other embodiments, the unmodified ACAM2000 virus has the sequence set forth in SEQ ID NO:71. Any modified ACAM2000 viruses or unmodified ACAM2000 viruses can be used to generate the CAVES systems provided herein.

Exemplary Immunomodulators and Therapeutic Proteins

The CAVES systems provided herein are generated by incubating an oncolytic virus with a suitable carrier cell for an amount of time that is sufficient for the expression of at least one virus-encoded immunomodulatory protein and/or a recombinant therapeutic protein. Exemplary viral immunomodulators and therapeutic proteins are described and provided below.

Immunomodulators

Viruses, including vaccinia virus (VACV), encode for several host range immunomodulators that block the initial anti-viral response in the tumor microenvironment, and protect infected cells against neutralization by complement and natural killer (NK) cells. These immunomodulators can be intracellular (non-secreted) or extracellular (secreted). For example, infected cells secrete proteins that bind to and disrupt the function of complement, interferons (IFNs), cytokines and chemokines, and interfere with semaphorin signaling. Secreted (extracellular) immunomodulators can prevent the interaction between chemokines and their host receptors on leukocytes, interfering with the migration of leukocytes into areas of infection and inflammation. Extracellular immunomodulators also can counteract the proinflammatory cytokine-induced antiviral state, for example, by disrupting TNF-alpha induced apoptosis in virus-infected cells. Intracellular immunomodulators inhibit apoptosis, modulate the antiviral effects of IFNs, and interfere with innate immune signaling and host gene transcription. For example, intracellular immunomodulators inhibit signaling pathways that lead to the production of interferons and proinflammatory chemokines and cytokines (Bahar et al. (2011) *J. Struct. Biol.* 175 (2-2): 127-134; Smith et al. (2013) *Journal of General Virology* 94:2367-2392). Different vaccinia strains encode different immunomodulators; thus, each viral strain interacts differently with host cells. The viruses herein can be genetically engineered to express intracellular and/or extracellular immunomodulators, increasing their virulence, or alternatively, they can be attenuated by deletion of the genes encoding immunomodulatory proteins.

Extracellular poxvirus immunomodulators that can be expressed by the viruses herein include the chemokine inhibitor/binding protein A41; the TNF inhibitors/binding proteins CrmB, CrmC, CrmD and CrmE; the MHC-like TNF-alpha inhibitor TPXV 2; the IL-18 binding protein C12; VACV CC chemokine inhibitor (vCCI), which prevents leukocyte recruitment; IFN-gamma binding protein (IFN-γ BP), which blocks binding of IFN-gamma to its receptor; the IL-1β-binding protein B15; the type I IFN-binding protein B18; the type II IFN-binding protein B8; complement control protein VCP (C21/β27); and the semaphorin 7A mimic A39 (Bahar et al. (2011) *J. Struct. Biol.* 175 (2-2): 127-134; Sumner et al. (2016) *Vaccine* 34:4827-4834; Nichols et al. (2017) *Viruses* 9, 215; Albarnaz et al. (2018) *Viruses* 10, 101).

Intracellular poxvirus immunomodulators that can be expressed by the viruses herein include hemagglutinin (HA, A56); thymidine kinase (TK); B5 (promotes viral dissemination); N1 (Bcl-2-like inhibitor of apoptosis and inhibitor of NF-κB/IRF3 activation); B14 and A52 (Bcl-2-like inhibitors of NF-κB); K7 (Bcl-2-like inhibitor of NF-κB and IFN-beta); F1 and M11 (Bcl-2-like anti-apoptotics); E3 (inhibitor of PKR activation, dsRNA binding protein); K3 (inhibits PKR mediated phosphorylation of eIF2α); C4 (inhibitor of NF-κB activation); C6 (IRF3/7 and JAK/STAT inhibitor); VH1 (dephosphorylates STAT1 and blocks expression of IFN-induced genes); A35 (inhibitor of MHC class II antigen presentation); B13 (SPI-2/CrmA) and B22 (SPI-1), which inhibit caspase activity; N2 (IRF3 inhibitor); D9 and D10 (de-capping enzymes); C16 (inhibitor of DNA sensing and promoter of hypoxic response); A49, K1 and M2 (inhibitors of NF-κB activation); protein 169 (inhibitor of translation); vGAAP (inhibitor of apoptosis); A44 (3β-hydroxysteroid dehydrogenase); and A46 (TLR signaling, NF-κB, IRF3 and MAPK inhibitor) (Bahar et al. (2011) *J. Struct. Biol.* 175 (2-2): 127-134; Sumner et al. (2016) *Vaccine* 34:4827-4834; Nichols et al. (2017) *Viruses* 9, 215; Albarnaz et al. (2018) *Viruses* 10, 101).

VCP (C3L)

The vaccinia virus complement control protein (VCP; encoded by C3L, C21L) is the major protein secreted from cells infected with vaccinia virus, and interacts with heparan sulfate proteoglycans (HSPGs) on the surfaces of uninfected cells. VCP also can be expressed on the surfaces of VACV infected cells, independently of HSPGs. The surface expression of VCP is dependent on its interaction with another viral protein, A56 (also known as hemagglutinin), present on the surface of vaccinia virus-infected cells and extracellular enveloped virus (EEV) particles. VCP inhibits the activation of classical and alternative complement pathways by accelerating the decay of C3 and C5 convertases, which is irreversible, and by acting as a cofactor for the factor I-mediated cleavage and inactivation of C3b and C4b (Girgis et al. (2008) *J. Virol.* 82 (8): 4205-4214; Smith et al. (2013) *Journal of General Virology* 94:2367-2392). A deletion mutant, lacking the C21L gene that encodes VCP, was attenuated in rabbits, and was associated with increased infiltration of $CD4^{+}$ and $CD8^{+}$T-cells, reduced viral titers and increased antibodies against VACV (Albarnaz et al. (2018) *Viruses* 10, 101).

Studies have shown that when VCP is engineered to contain a transmembrane domain that allows it to be expressed on the cell surface, it is capable of protecting cells from complement-mediated lysis, demonstrating a threefold decrease in lysis in the presence of VCP. (Rosengard et al. (1999) *Mol. Immunol.* 36 (10): 685-697). By protecting vaccinia-infected cells from lysis, surface-bound VCP prolongs viral production and results in increased viral titers. The reduction in complement activation on the cell surfaces also reduces the production of proinflammatory peptides, such as C3a and C5a, which reduces local inflammation and immune system activation (Girgis et al. (2008) *J. Virol.* 82 (8): 4205-4214).

B5

B5 (encoded by B5R), a member of the complement protein family, is a type I integral membrane glycoprotein present in the extracellular enveloped virus (EEV) outer envelope, that is needed for the formation of EEV and promotes viral dissemination (Smith et al. (2013) *Journal of General Virology* 94:2367-2392).

Thymidine Kinase (TK)

VACV thymidine kinase (TK), encoded by the early VACV J2R gene, is a virulence factor that, when deleted from the viral genome, results in attenuated vaccinia virus strains (Yakubitskiy et al. (2015) *Acta Naturae* 7 (4): 113-121). HA (A56)

Natural killer (NK) cells, which play an important role in the immune defense against orthopox family members such as vaccinia virus (VACV or VV), are regulated through inhibitory and activating signaling receptors. The activating signaling receptors include NKG2D and natural cytotoxicity receptors (NCRs) such as NKp46, NKp44 and NKp30. NCRs are important activating receptors for the anti-viral and anti-tumor activity of NK cells (Jarahian et al. (2011) *PLoS Pathogens* 7(8): e1002195).

Hemagglutinin (HA) (encoded by A56R), also known as A56, is a protein that mediates viral attachment to host cells, inhibits fusion of infected cells, and promotes proteolytic activation of infectivity (Yakubitskiy et al. (2015) *Acta Naturae* 7 (4): 113-121). HA, which is expressed as a late-phase product on the surface of VACV-infected cells, is a viral ligand for the activating receptors NKp30 and NKp46. HA/A56 has been shown to block NKp30-triggered activation, resulting in a decreased susceptibility of infected cells to NK lysis at late time points of VACV expression, when HA expression is pronounced. Thus, HA is a conserved ligand of NCR and results in immune escape through its blocking effect on NKp30-mediated activation at a late stage of infection (Jarahian et al. (2011) *PLoS Pathogens* 7(8): e1002195).

Deletion of A56R from the VACV genome resulted in a 40-fold decrease in the $LD_{50}$ in mice, compared to the parent strain. Thus, inactivation of the HA gene in VACV leads to significant attenuation (Yakubitskiy et al. (2015) *Acta Naturae* 7(4): 113-121).

B18

VACV protein B18 (encoded by B18R) is a soluble extracellular immunomodulatory protein that binds type-I interferon and exhibits activity as a "decoy IFN receptor" in solution, and when associated with the cell surface via glycosaminoglycans (GAGs), sequestering type-I IFNs produced by uninfected cells, particularly IFN-α. When B18 binds to cell surfaces, preventing the induction of the IFN-mediated antiviral state in uninfected cells, the cells remain susceptible to viral infection and replication (Smith et al. (2013) Journal of General Virology 94:2367-2392; Albarnaz et al. (2018) Viruses 10, 101).

B8

B8 (encoded by B8R) is a soluble VACV decoy type-II IFN receptor that binds IFN-γ extracellularly. Deletion of B8, which is a homologue to the extracellular domain of the IFN-γ receptor, resulted in attenuation of VACV, in comparison to wild-type VACV, in mouse infection studies (Yakubitskiy et al. (2015) *Acta Naturae* 7 (4): 113-121). Unlike cellular IFN-γR, B8 can dimerize in the absence of IFN-γ (Smith et al. (2013) Journal of General Virology 94:2367-2392).

B15

VACV protein B15 (encoded by B15R) is a soluble IL-1R that is secreted by infected cells and binds IL-1ß with high affinity, preventing it from binding to its natural receptor. Studies have shown that viruses lacking the B15R gene exhibit reduced virulence (Smith et al. (2013) Journal of General Virology 94:2367-2392).

A39/A39R

A39/A39R is a secreted immunomodulatory glycoprotein, similar in amino acid sequence to glycophosphatidylinositol-linked cell surface semaphorin. A39R is expressed late during infection and has been shown to have pro-inflammatory properties, and to affect the outcome of infection, in a murine intradermal model (Gardner et al. (2001) J. Gen. Virol. 82:2083-2093).

CrmA/β13/SPI-2

Cytokine response modifier A (CrmA) (also known as B13/β13R or serine proteinase inhibitor 2 (SPI-2)) is an orthopoxvirus protein that is expressed early in the viral infection process and remains inside the host cell. CrmA binds caspase-1 and blocks pro-IL-1ß cleavage to IL-1B, a proinflammatory cytokine that is important in controlling poxvirus infections. By inhibiting the activation of multiple caspases (e.g., caspase 1, caspase 8), CrmA/β13 also inhibits apoptosis. B13 additionally inhibits the formation of mature IL-18 (Smith et al. (2013) Journal of General Virology 94:2367-2392; Nichols et al. (2017) Viruses 9, 215).

SPI-1/β22R

Vaccinia virus SPI-1 (also known as B22 or B22R) is an intracellular immunomodulatory protein similar to SPI-2/CrmA, that inhibits caspase activity. Studies have shown that a mutated VACV, lacking the SPI-1/β22R gene displayed lower viral replication in A549 cells. Infected cells are sensitive to TNF-induced apoptosis, indicating the significant role that SPI-1 plays in virulence (Nichols et al. (2017) Viruses 9, 215).

Viral TNF Receptors (vTNFRs)

Viral TNF receptors (vTNFRs) are soluble, secreted decoy receptors that bind TNFα, preventing it from binding to its natural receptor, and mitigating its antiviral effects. The vTNFRs, which include cytokine response modifier B (CrmB), CrmC, CrmD and CrmE (A53), mimic the extracellular domain of the cellular TNF receptors TNFR1 and TNFR2, and differ in their ligand affinity and expression in orthopoxviruses. Studies have shown that vTNFRs enhance the virulence of recombinant VACV. For example, VACV strain USSR mutants lacking CrmE were attenuated, while a recombinant strain of VACV WR expressing CrmE displayed increased virulence (Nichols et al. (2017) *Viruses* 9, 215; Smith et al. (2013) *Journal of General Virology* 94:2367-2392; Bahar et al. (2011) *J. Struct. Biol.* 175 (2-2): 127-134).

C12

C12 (encoded by C12L) is a soluble orthopoxvirus protein that binds IL-18 in solution, preventing it from interacting with its natural receptor, IL-18R. C12 increases the virulence of VACV by inhibiting the IL-12 induced production of IFN-Y, which inhibits NK cell and VACV-specific CD8$^{+}$ T-cell responses (Smith et al. (2013) *Journal of General Virology* 94:2367-2392). Deletion of the C12L gene has been shown to result in viral attenuation, with increased levels of IL-18 and IFN-γ, and enhanced NK-cell cytotoxicity and CTL response after intranasal infection of mice (Albarnaz et al. (2018) *Viruses* 10, 101).

VACV CC Chemokine Inhibitor (vCCI)

Chemokines are small chemo-attractant cytokines that recruit leukocytes to sites of infection and inflammation. Chemokines binds to GAGs on the surfaces of adjacent endothelial cells, creating a concentration gradient, and recruiting circulating leukocytes by binding to their chemokine receptors. VACV CC chemokine inhibitor (vCCI), also known as VACV chemokine-binding protein (vCKBP), which is secreted by virus-infected cells during the early stages of infection, binds CC chemokines, preventing them from binding to their receptors. This prevents the recruitment of leukocytes to the site of infection, reducing inflammation (Smith et al. (2013) *Journal of General Virology* 94:2367-2392).

A41

Whereas most viral CC chemokine inhibitors bind chemokines at their receptor-binding sites, preventing their interaction with, and recruitment of leukocytes to sites of inflammation, A41 (encoded by A41L) is an extracellular VACV immunomodulatory protein that binds chemokines at their GAG-binding site, rather than the receptor-binding site (Bahar et al. (2011) J. Struct. Biol. 175 (2-2): 127-134). A41 also is secreted by infected cells during the early stages of infection, but binds chemokines with a lower affinity than vCCI, and does not prevent chemokines from binding to their respective chemokine receptors. Instead, A41 disrupts the chemokine concentration gradients on the surfaces of endothelial cells, which are important for the recruitment of leukocytes (Smith et al. (2013) *Journal of General Virology* 94:2367-2392; Albarnaz et al. (2018) *Viruses* 10, 101).

VH1

VACV VH1 is an intracellular immunomodulatory protein (phosphatase) that inhibits the transcription factors STAT1 (signal transducer and activator of transcription 1) and STAT2 by dephosphorylation, inhibiting signaling from all IFN receptors and preventing the expression of antiviral genes (Bahar et al. (2011) *J. Struct. Biol.* 175 (2-2): 127-134; Smith et al. (2013) Journal of General Virology 94:2367-2392).

K3

K3 is a VACV intracellular immunomodulatory protein that inhibits PKR-mediated phosphorylation of eIF2α. In virus-infected cells, STAT1 induces expression of dsRNA-dependent protein kinase (PKR), which detects dsRNA produced during VACV transcription, and phosphorylates and inhibits the host protein translation factor elF2a (eukaryotic translation initiation factor 2 alpha), arresting the synthesis of host and viral proteins in infected cells, and leading to apoptosis. K3 is a viral mimic of the N-terminal 88 amino acids of eIF2α, that binds PKR by acting as a non-phosphorylatable pseudo-substrate, and prevents PKR-induced apoptosis by inhibiting the phosphorylation of elF2a by PKR (Bahar et al. (2011) *J. Struct. Biol.* 175 (2-2): 127-134; Smith et al. (2013) *Journal of General Virology* 94:2367-2392)

N1

B-cell lymphoma 2 (Bcl-2) proteins can be pro- or anti-apoptotic, and regulate the release of pro-apoptotic molecules from the mitochondria. Several viruses, including herpesvirus, adenovirus and VACV, express anti-apoptotic Bcl-2 and Bcl-2-like proteins to evade host cell death. For example, N1 (encoded by NIL) is a VACV virulence factor that functions as an intracellular immunomodulator and is similar in structure to anti-apoptotic Bcl-2 proteins. N1 binds BH3 motifs of pro-apoptotic proteins, inhibiting apoptosis in VACV-infected cells. N1 has been shown to interact with host pro-apoptotic Bcl-2 proteins such as Bid, Bad, Bak and Bax, and has been shown to inhibit innate immune signaling pathways by binding to the IκB kinase (IKK) complex and TANK binding kinase 1 (TBK1), inhibiting activation of nuclear factor (NF)-κB and IRF3 (Bahar et al. (2011) *J. Struct. Biol.* 175 (2-2): 127-134).

F1

F1 (encoded by FIL) is a VACV intracellular immunomodulator that is a poxviral Bcl-2-like family protein and inhibits the apoptosis of virus-infected cells. F1 binds to the BH3 motifs of pro-apoptotic Bcl-2 proteins and, unlike N1, which is found in the cytosol, is localized to the mitochondrial membrane, where it interacts with host pro-apoptotic Bcl-2 proteins such as Bak and Bax, which initiate apoptosis at the mitochondrial membrane (Bahar et al. (2011) *J. Struct. Biol.* 175 (2-2): 127-134). F1 also reduces the inflammatory response by binding to NLRP-1, which is an upstream activator of caspase-1 (Smith et al. (2013) *Journal of General Virology* 94:2367-2392), and binds to, and inhibits, caspase 9 (Albarnaz et al. (2018) *Viruses* 10, 101).

Bcl-2-Like Proteins that Inhibit the NF-κB Pathway

Nuclear factor (NF)-KB is a transcription factor complex that stimulates the innate and adaptive immune responses to infection. Receptors for proinflammatory cytokines such as TNFa and IL-1, and Toll-like receptors (TLRs), which recognize pathogen associated molecular patterns (PAMPs), activate signaling pathways that lead to NF-κB activation. VACV encodes several Bcl-2-like proteins, including N1, A52, B14 and K7, that inhibit the NF-κB signaling pathway. While N1 inhibits apoptosis, A52, B14 and K7, which lack the BH3-binding grooves, do not. B14 inhibits NF-κB activation and acts at the IKK complex by binding IKKß and preventing its phosphorylation and the phosphorylation of IκBα. A52 and K7 inhibit signaling upstream of B14, by inhibiting TLR-induced signaling and TLR- and IL-1β-mediated NF-κB activation (via binding to TRAF6 and IRAK2). K7 (encoded by K7L) also forms a complex with the human DEAD-box RNA helicase 3 (DDX3), antagonizing IFN-beta promoter induction and inhibiting the production of pro-inflammatory cytokines (Bahar et al. (2011) *J. Struct. Biol.* 175 (2-2): 127-134; Smith et al. (2013) *Journal of General Virology* 94:2367-2392; Albarnaz et al. (2018) *Viruses* 10, 101).

A46

A46 (encoded by A46R) is an intracellular VACV immunomodulatory protein that binds to Toll/IL-1R (TIR) domain-containing adaptor molecules (such as, for example, MyD88, MAL, TRIF and TRAM) that associate with the cytoplasmic tails of TLRs. This, in turn, inhibits activation of MAP kinases, NF-κB, and IRF3, which inhibits the induction of IFN-beta (Smith et al. (2013) *Journal of General Virology* 94:2367-2392). A VACV WR A46R deletion mutant was found to be attenuated in comparison to control viruses (Albarnaz et al. (2018) Viruses 10, 101).

Other proteins that inhibit NF-κB activation

A49 is an intracellular VACV protein that stabilizes phosphorylated IκBα (inhibitor of κB), by preventing its recognition and degradation, such that IκBα remains bound to NF-κB in the cytoplasm. Intracellular VACV protein C4 inhibits NF-κB activation at, or downstream of, the IKK complex, but the mechanism remains unknown. VACV protein E3 (encoded by E3L) inhibits NF-κB activation by PKR-dependent and independent mechanisms and by antagonizing the RNA polymerase III-dsDNA sensing pathway. E3 binds and sequesters dsRNA from cellular pattern recognition receptors (PRRs), preventing the cell from identifying viral dsRNA. In addition to E3, the VACV decapping enzymes D9 and D10 prevent the accumulation of dsRNA by de-capping viral mRNAs, preventing the activation of PKR and dsRNA induced anti-viral pathways. VACV protein K1 inhibits NF-κB activation by preventing the degradation of IκBα. Protein M2 reduces phosphorylation of extracellular signal-regulated kinase 2 (ERK2) induced by phorbol myristate acetate, and prevents p65 nuclear translocation (Smith et al. (2013) *Journal of General Virology* 94:2367-2392; Nichols et al. (2017) *Viruses* 9, 215; Albarnaz et al. (2018) *Viruses* 10, 101).

C6

C6 (encoded by C6L) is an intracellular immunomodulatory protein that enhances virulence and inhibits activation of IRK3 and IRF7 by binding to the adaptor proteins needed to activate the upstream kinases TANK-binding kinase 1 (TBK1) and IKKE. This results in the inhibition of type-I IFN production. C6 also inhibits the activation of the JAK/STAT signaling pathway after type I IFNs bind to their receptors, preventing the transcription of interferon-stimulated genes (ISGs). Deletion of C6L has been shown to enhance CD8+ and CD4+T-cell responses (Albarnaz et al. (2018) Viruses 10, 101).

C16

C16, an intracellular immunomodulatory protein, inhibits DNA sensing that leads to IRF3-dependent innate immunity, by binding to the proteins Ku70 and Ku80, which are subunits of the DNA-PK complex (a DNA sensor). C16 also binds the oxygen sensor prolylhydroxylase domain-containing protein 2 (PHD2), preventing the hydroxylation of hypoxia-inducible transcription factor (HIF)-la. This prevents the ubiquitylation and degradation of HIF-la, and the stabilized HIF-la induces transcription of genes that lead to a hypoxic response. Deletion of C16 has been shown to result in faster pulmonary recruitment and activation of CD8+ and CD4+T-cells (Albarnaz et al. (2018) *Viruses* 10, 101).

N2

Protein N2 is an intracellular immunomodulatory protein with a Bcl-2 fold that inhibits IRF3 activation by an unknown mechanism. Deletion of N2 from VACV strain WR resulted in decreased virulence and increased pulmonary cell infiltration (Albarnaz et al. (2018) *Viruses* 10, 101).

Protein 169

Protein 169 is an intracellular immunomodulatory protein that suppresses the immune response by inhibiting the initiation of cap-dependent and cap-independent translation (Albarnaz et al. (2018) *Viruses* 10, 101).

Protein A35

Protein A35, which is encoded by A35R, is an intracellular immunomodulatory protein that restricts antigen presentation to T-cells via MHC class II molecules. A35R deletion mutants were attenuated, and resulted in lower VACV-specific antibodies, decreased IFN-γ secretion and decreased lysis by splenocytes (Albarnaz et al. (2018) Viruses 10, 101).

Protein A44

Protein A44 is an intracellular immunomodulator that is a 3β-hydroxysteroid dehydrogenase (3β-HSD) and promotes virulence. A VACV strain WR mutant lacking protein A44 resulted in an enhanced inflammatory response, increased IFN-γ levels, rapid recruitment of $CD8^+$ and $CD4^+$T-cells, and a stronger cytolytic T-cell response to VACV-infected cells (Albarnaz et al. (2018) Viruses 10, 101). vGAAP The viral Golgi anti-apoptotic protein (vGAAP) is a hydrophobic protein that localizes predominantly to the Golgi and inhibits apoptosis. VACV vGAAP inhibits both the intrinsic and extrinsic apoptotic pathways, induced by staurosporine, TNFα/cycloheximide (CHX), Fas antibodies, doxorubicin, cisplatin, and C2 ceramide, as well as apoptosis induced by the overexpression of Bax. vGAAP forms ion channels that result in the leakage of Ca2+, reducing its concentration in the Golgi apparatus, and affecting apoptotic pathways that are mediated by the release of Ca2+ (Nichols et al. (2017) Viruses 9, 215).

Therapeutic Proteins

The oncolytic viruses used to generate the CAVES provided herein also can be engineered to express a recombinant therapeutic protein. Exemplary therapeutic proteins are described below; these proteins also can be administered separately, as a combination therapy with the CAVES systems provided herein.

Immune Checkpoints

Immune checkpoints are involved in the regulation of the immune system and preventing autoimmunity, and include stimulatory and inhibitory pathways. Viral infections stimulate immune and inflammatory pathways and responses, while tumors have evolved to evade the immune system, for example, by activating inhibitory immune checkpoint pathways to inhibit the anti-tumor immune response. Modification of the viruses herein, by adding genes encoding molecules that induce desirable immunostimulatory anti-tumor responses, or that inhibit immune checkpoint pathways that promote tumor immune evasion, can improve the anti-tumor activity of the viruses. This can be achieved by agonism of co-stimulatory pathways, antagonism of co-inhibitory pathways, or both. For example, the viruses herein can be modified to express co-stimulatory molecules, or agonists of co-stimulatory molecules, or inhibitors of immune checkpoint pathways that tumors use for immune evasion, to improve the anti-tumor immune response.

Immune Checkpoint Inhibitors

Immune checkpoint inhibitors are immune suppression antagonists that are critical for the maintenance of self-tolerance, but that can be overexpressed by tumors as a means to evade detection by the immune system (Meyers et al. (2017) *Front. Oncol.* 7:114). Programmed cell death protein 1 (PD-1; also known as CD279) and its cognate ligand, programmed death-ligand 1 (PD-L1; also known as B7-H1 and CD274), are two examples of numerous inhibitory "immune checkpoints," which function by downregulating immune responses. For example, upregulation of PD-1 on T cells, and its binding to PD-L1, which is expressed on both antigen presenting cells (APCs) and tumor cells, interferes with CD8+ T cell signaling pathways, impairing the proliferation and effector function of CD8+ T cells, and inducing T cell tolerance. Anti-PD-1 antibodies (for example, pembrolizumab, nivolumab, pidilizumab) and anti-PD-L1 antibodies (for example, atezolizumab, BMS-936559, avelumab (MSB0010718C) and durvalumab) can be expressed by the viruses herein to enhance the antitumor effect.

Another inhibitory immune checkpoint is cytotoxic T-lymphocyte-associated protein 4 (CTLA-4; also known as CD152), which is expressed on T cells and binds to and inhibits co-stimulatory receptors on APCs, such as CD80 or CD86, out-competing the co-stimulatory cluster differentiation 28 (CD28), which binds the same receptors, but with a lower affinity. This blocks the stimulatory signal from CD28, while the inhibitory signal from CTLA-4 is transmitted, preventing T cell activation (see, Phan et al. (2003) *Proc. Natl. Acad. Sci. U.S.A.* 100:8372-8377). Inhibition of CTLA-4 enhances immune responses mediated by CD4+T helper cells, and leads to the inhibition of the immunosuppressive effects of Tregs. (Pardoll, D. M. (2012) *Nat. Rev. Cancer* 12 (4): 252-264). Anti-CTLA-4 antibodies, such as ipilimumab and tremelimumab, can be encoded by the viruses herein to enhance the antitumor effect.

Lymphocyte-activation gene 3 (LAG3; also known as CD223) is another T-cell associated inhibitory molecule, which is expressed by T cells and NK cells following MHC class II ligation, and has a negative regulatory effect on T cell function. Monoclonal antibodies against LAG-3 can be used to inhibit LAG-3. Additionally, LAG-3-Ig fusion protein (IMP321, Immuntep®), a soluble form of LAG-3 that upregulates co-stimulatory molecules and increases IL-12 production, enhancing tumor immune responses, has been shown to increase tumor reactive T cells in clinical trials (Marin-Acevedo et al. (2018) *Journal of Hematology &* Oncology 11:39).

T cell immunoglobulin and mucin-domain containing-3 (TIM-3, also known as hepatitis A virus cellular receptor 2 (HAVCR2)), is a direct negative regulator of T cells that is expressed on NK cells and macrophages and promotes immunosuppression by inducing expansion of myeloid-derived suppressor cells (MDSCs). Monoclonal antibodies against TIM-3, such as MBG453, can increase T cell proliferation and cytokine production (Marin-Acevedo et al. (2018) *Journal of Hematology* & Oncology 11:39).

V-domain Ig suppressor of T cell activation (VISTA), also known as programmed death-1 homolog (PD-1H), suppresses T cell activation and proliferation and cytokine production. Studies have shown that blocking VISTA increases TIL activation and enhances tumor-specific T cell responses. Monoclonal antibodies against VISTA (for example, JNJ-61610588) and inhibitors (for example, the oral inhibitor CA-170) are being investigated in clinical trials (Marin-Acevedo et al. (2018) *Journal of Hematology & Oncology* 11:39).

B7-H3 (also known as CD276) is expressed on APCs, NKs, B cells and T cells, and inhibits T cell activation and proliferation, as well as cytokine production. B7-H3 is overexpressed in several types of cancer, including melanoma, NSCLC, prostate, pancreatic, ovarian and colorectal cancer. Enoblituzumab (MGA271), a humanized monoclonal antibody against B7-H3, and 8H9, an anti-B7-H3 antibody labeled with radioactive iodine, have shown anti-tumor activity (Marin-Acevedo et al. (2018) *Journal of Hematology & Oncology* 11:39).

B- and T-lymphocyte attenuator (BTLA, or CD272) is an inhibitory receptor that is expressed by the majority of lymphocytes, that, when bound by its ligand, herpes virus entry mediator (HVEM), blocks B and T cell activation, proliferation and cytokine production (Marin-Acevedo et al. (2018) *Journal of Hematology & Oncology* 11:39).

Killer-cell immunoglobulin-like receptors (KIRs, also known as CD158) are expressed by NK and T cells and decrease lymphocyte activation, cytotoxic activity and cytokine release. Antibodies against KIRs include lirilumab and IPH4102 (Marin-Acevedo et al. (2018) *Journal of Hematology & Oncology* 11:39).

Indoleamine 2,3-dioxygenase (IDO) is a tryptophan-degrading enzyme that is involved in immunosuppression and is overexpressed in several tumor types, including melanoma, chronic lymphocytic leukemia, ovarian cancer, CMC and sarcomas. IDO inhibitors can be used in immune checkpoint therapy, and include BMS-986205, indoximod and epacadostat (Marin-Acevedo et al. (2018) *Journal of Hematology & Oncology* 11:39).

Additionally, the adenosine receptor A2aR inhibits T cell responses, and its deletion has been shown to enhance inflammatory responses to infection. A2aR can be inhibited by antibodies that block adenosine binding, or by adenosine analogs (Pardoll, D. M. (2012) *Nat. Rev. Cancer* 12 (4): 252-264).

Other inhibitory immune checkpoint molecules that can be targeted for cancer immunotherapy by the viruses herein include, but are not limited to, signal regulatory protein a (SIRPa), programmed death-ligand 2 (PD-L2), indoleamine 2,3-dioxygenase (IDO) 1 and 2, galectin-9, T cell immunoreceptor with Ig and ITIM domains (TIGIT), herpesvirus entry mediator (HVEM), CTNNB1 (β-catenin), TIM1, TIM4, CD39, CD73, B7-H4 (also called VTCN1), B7-H6, CD47, CD48, CD80 (B7-1), CD86 (B7-2), CD112, CD155, CD160, CD200, CD244 (2B4), and carcinoembryonic antigen-related cell adhesion molecule 1 (CEACAMI, or CD66a).

While immune checkpoint inhibitors have demonstrated success for anti-cancer therapy in responding patients, many patients do not respond, possibly due to the lack of active tumor-specific T cells in the TME. Because oncolytic virotherapy induces antitumor adaptive immunity, oncolytic virotherapy has been combined with immune checkpoint inhibitors. For example, a combination of T-VEC and CTLA-4 inhibition has shown results in the treatment of melanoma (Meyers et al. (2017) *Front. Oncol.* 7:114).

Viruses described herein, and vaccinia viruses provided herein can be engineered to express inhibitors of immune checkpoints. Such targets for inhibition include, but are not limited to, CTLA-4, PD-1, PD-L1, TIM-3, and LAG-3. Immune checkpoint inhibitors include, for example, antibodies, such as anti-PD-1 antibodies (e.g., pembrolizumab, nivolumab), anti-PD-L1 antibodies (e.g., atezolizumab, avelumab and durvalumab), anti-CTLA-4 antibodies (e.g., ipilimumab), anti-TIM-3 antibodies (e.g., MBG453), and anti-LAG-3 antibodies (e.g., relatlimab/BMS-986016).

Co-stimulatory Molecules

While inhibitory pathways attenuate the immune system, co-stimulatory molecules enhance the immune response against tumor cells. Co-stimulatory pathways thus are inhibited by tumor cells to promote tumorigenesis. Viruses described and provided herein can be engineered to express co-stimulatory molecules, such as, for example, CD27, CD70, CD28, CD30, CD40, CD40L (CD154), CD122, CD137 (4-1BB), 4-1BBL, OX40 (CD134), OX40L (CD252), CD226, glucocorticoid-induced TNFR family related gene (GITR), herpes-virus entry mediator (HVEM), LIGHT (also known as TNFSF14), B7-H2, and inducible T-cell costimulator (ICOS; also known as CD278). It has been shown, for example, that the expression of 4-1BBL in murine tumors enhances immunogenicity, and intratumoral injection of dendritic cells (DCs) with increased expression of OX40L can result in tumor rejection in murine models. Studies have also shown that injection of adenovirus expressing recombinant GITR into B16 melanoma cells promotes T cell infiltration and reduces tumor volumes.

Stimulatory antibodies to molecules such as 4-1BB, OX40 and GITR also can be encoded by the viruses to stimulate the immune system. For example, agonistic anti-4-1BB monoclonal antibodies have been shown to enhance anti-tumor CTL responses, and agonistic anti-OX40 antibodies have been shown to increase anti-tumor activity in transplantable tumor models. Additionally, agonistic anti-GITR antibodies have been shown to enhance anti-tumor responses and immunity (Peggs et al. (2009) *Clinical and Experimental Immunology* 157:9-19).

OX40 (CD134) is a member of the TNF receptor superfamily, which, together with its ligand (OX40L) results in the activation, potentiation, proliferation and survival of T cells, as well as the modulation of NK cell function. Agonistic monoclonal antibodies can be used to activate OX40, increasing antitumor activity by the immune system. These include, for example, MOXR 0916, PF-04518600 (PF-8600), MEDI6383, MEDI0562, MEDI6469, INCAGN01949 and CSK3174998 (Marin-Acevedo et al. (2018) *Journal of Hematology & Oncology* 11:39).

Glucocorticoid-induced TNFR family-related protein (GITR), is a co-stimulatory cell surface receptor that is expressed by T and NK cells, and whose expression increases after T cell activation. Its ligand, GITRL, is expressed by APCs and endothelial cells, and plays a role in the upregulation of the immune system, leukocyte adhesion and migration. Agonistic GITR antibodies include TRX-518, BMS-986156, AMG 228, MEDI1873, MK-4166, INCAGN01876 and GWN323 (Marin-Acevedo et al. (2018) *Journal of Hematology & Oncology* 11:39).

Inducible T-cell co-stimulator (ICOS; also known as CD278), which is mainly expressed by $CD4^+$ T cells, is a co-stimulator of proliferation and cytokine production. Agonistic antibodies of ICOS include JTX-2011, GSK3359609 and MEDI-570 (Marin-Acevedo et al. (2018) Journal of Hematology & Oncology 11:39). 4-1BB (CD137) is an inducible co-stimulatory receptor that is expressed by T cells, NK cells and APCs, which binds its ligand, 4-1BBL to trigger immune cell proliferation and activation. Anti-4-1BB agonists have been shown to increase immune-mediated antitumor activity, and include utomilumab (PF-05082566) and urelumab (Marin-Acevedo et al. (2018) Journal of Hematology & Oncology 11:39).

CD27 is a member of the TNF receptor family, which, after binding its ligand, CD70, results in the activation and differentiation of T cells into effector and memory cells and the boosting of B cells. Agonistic CD-70 antibodies include ARGX-110 and BMS-936561 (MDX-1203), and agonistic CD27 antibodies include varlilumab (Marin-Acevedo et al. (2018) Journal of Hematology & Oncology 11:39).

CD40 is another member of the TNF receptor family. CD40 is expressed by APCs and B cells, while its ligand, CD154 (CD40L), is expressed by activated T cells. Interaction between CD40 and CD154 stimulates B cells to produce cytokines, resulting in T cell activation and tumor cell death. Monoclonal antibodies against CD40 include CP-870893 (agonistic), APX005M (agonistic), ADC-1013 (agonistic), lucatumumab (antagonistic), Chi Lob 7/4 (agonistic), dacetuzumab (partial agonist), SEA-CD40 (agonistic) and RO7009789 (agonistic) (Marin-Acevedo et al. (2018) *Journal of Hematology & Oncology* 11:39).

Other Expression Products

In addition to immunomodulatory proteins, immune checkpoint inhibitors and co-stimulatory molecules (and their agonists), the viruses herein can be engineered to express other molecules to enhance their antitumor effects, such as, for example, prostaglandin E2/COX-2 inhibitors, nutrient-depleting enzymes (e.g., arginase, arginine deiminase, asparaginase), cytokines (e.g., GM-CSF, IL-2, IL-7, IL-10, IL-12, IL-15, IL-18, IL-21, IFN-γ, IFN-α, IFN-β, TNF-α, TGF-B), chemokines (e.g., CCL2, CCL5, CCL19, CXCL11, RANTES), BiTEs (e.g., blinatumomab (MT-103), solitomab (MT110), MT-111, BAY2010112 (AMG112), catumaxomab), tumor neo-antigens and tumor-associated antigens (e.g., alphafetoprotein (AFP), carcinoembryonic antigen (CEA), CA-125, MUC-1, cancer testis antigens (CTAs), New York esophageal squamous cell carcinoma-1 (NY-ESO-1), E6/E7, SV40, MART-1, PRAME, CT83, SSX2, BAGE family, CAGE family, epithelial tumor antigen (ETA), prostate specific antigen (PSA), prostate specific membrane antigen (PSMA), melanoma-associated antigens (MAGEs), tyrosinase, CD19, GP100, telomerase, cyclin B1, survivin, mesothelin, EPHA2, HER2), angiogenesis inhibitors e.g., for tumor blood vessels reprogramming (e.g., bevacizumab, gefitinib, thalidomide (Immunoprin), lenalidomide, sorafenib (Nexavar®), sunitinib, axitinib (Inlyta®), temsirolimus (Torisel®), pazopanib, cabozantinib, everolimus, ramucirumab (Cyramza®), regorafenib, vandetanib, tanibirumab, olaratumab (Lartruvo®), nesvacumab, AMG780, MEDI3617, vanucizumab, rilotumumab (AMG102), ficlatuzumab, TAK-701, onartuzumab (MetMab), emibetuzumab, aflibercept, imatinib), and other therapeutic antibodies (e.g., alemtuzumab (Campath®), trastuzumab (Herceptin®), cetuximab (Erbitux®), panitumumab (Vectibix®), ofatumumab (Arzerra®), rituximab (Rituxan®/MabThera®), gemtuzumab ozogamicin (Mylotarg®), brentuximab vedotin (Adcetris®), tositumomab, daratumumab (Darzalex®), dinutuximab (Unituxin®), elotuzumab (Empliciti™), necitumumab (Portrazza™), obinutuzumab (Gazyva®) and pertuzumab (Perjeta®)). The viruses can be modified to express reporter genes and imaging molecules, such as, but not limited to fluorescent proteins, luminescent proteins, NIS, and aquaporin 1.

Prostaglandin E2 Blockade

Cyclooxygenase (COX-2) mediated production of prostaglandin E2 (PGE2) has been shown to result in MDSC tumor infiltration, maintenance of the immunosuppressive phenotype, and inhibition of CTL activity. Blockade of the COX-2/PGE2 pathway has been shown to enhance tumor immune responses. For example, an oncolytic vaccinia virus expressing the prostaglandin-inactivating enzyme hydroxyprostaglandin dehydrogenase 15-(NAD) (HPGD) resulted in the reduction of the number of MDSCs in tumors in a non-toxic manner. Expression of HPGD was found to enhance the attraction of T cells and sensitize resistant tumors to different immunotherapies, including anti-PD-1 antibodies. In another study, the use of aspirin to block COX-2 activity was shown to sensitize tumors to anti-PD-1 therapy. PGE2-depleting antibodies, such as celecoxib (Celebrex®), and agonists of the PGE2 receptors EP2 and EP4 also can be used for PGE2 inhibition/blockade to enhance cancer immunotherapies (Hou et al. (2016) *Cancer Cell* 30:108-119; Miao et al. (2017) *Oncotarget* 8 (52): 89802-89810).

Nutrient-Depleting Enzymes

Cancer is characterized by uncontrollable growth, and tumor cells have specific nutrient auxotrophies and a higher nutrient demand than normal cells. As a result, nutrient-depleting enzymes can be used in anti-cancer therapy. For example, tumor cells can be starved of asparagine, arginine and glutamine, resulting in caspase-dependent apoptosis or autophagic cell death.

Asparaginase

Asparagine is involved in cellular respiration and protein synthesis, and also acts as a neurotransmitter in neuroendocrine tissues. Studies have also shown that asparagine can suppress apoptosis in cancer cells. Asparaginase is an enzyme that converts asparagine to aspartic acid. The depletion of L-asparagine by L-asparaginase can induce apoptosis, rendering it useful in the treatment of some cancers. For example, asparaginase is used in the treatment of pediatric acute lymphoblastic leukemia (ALL), where it depletes extracellular asparagine, which ALL cells cannot synthesize. Therapeutic asparaginase can be derived from *E. coli* or *Erwinia chrysanthemi*, and also exists as a PEGylated formulation. Bacterial-derived asparaginases, however, often result in adverse immune reactions due to the generation of anti-asparaginase antibodies, which can range from a localized rash to life-threatening anaphylaxis. These adverse reactions significantly impede therapy in adults. PEGylated asparaginase has a longer serum half-life, allowing for lower and less frequent doses to be administered, and results in fewer adverse reactions than bacterial asparaginase formulations (Fung and Chan (2017) *Journal of Hematology & Oncology* 10:144; Koprivnikar et al. (2017) *OncoTargets and Therapy* 10:1412-1422).

L-asparaginase can be loaded into red blood cells (RBCs) for therapy, and this formulation has been tested in several early-phase clinical trials. The enzyme remains encapsulated in the RBCs, preventing the binding of antibodies, which slows down clearance from the body and decreases the risk of adverse reactions. Studies have shown that patients receiving RBC-encapsulated asparaginase exhibited fewer allergic reactions than patients injected with *E. coli* asparaginases (Koprivnikar et al. (2017) *OncoTargets and Therapy* 10:1412-1422).

Bacterial L-asparaginase has also been shown to breakdown L-glutamine into L-glutamate, resulting in glutamine depletion. Cancer cells have a high demand for glutamine, which can be used for nucleotide and glutathione synthesis, for the synthesis of other amino acids, or for the generation of ATP for energy. Glutamine depletion results in MYC-mediated apoptosis in cancer cells (Fung and Chan (2017) *Journal of Hematology & Oncology* 10:144).

Arginine Depletion

Arginine is a precursor for cancer-associated factors such as nitric oxide (NO), which can be tumorigenic in nanomolar concentrations. Arginine depleting agents include PEGylated arginine deiminase (ADI) and PEGylated arginase I. ADI converts arginine into citrulline. It is not produced by human cells and is derived from microorganisms, making it a foreign protein that can result in adverse immune responses. PEGylation, for example to generate ADI-PEG20, has been shown to reduce immunogenicity and increase the half-life. ADI-PEG20 was found to effectively suppress tumor growth and induce apoptosis and autophagy in different cancer types in pre-clinical studies. Additionally, clinical studies using ADI-PEG20 for the treatment of melanoma, hepatocellular carcinoma and mesothelioma have shown that it is well tolerated in patients (Fung and Chan (2017) *Journal of Hematology & Oncology* 10:144).

PEGylated human arginase I (PEG-ARG I), which converts arginine to ornithine, is under clinical investigation for the treatment of cancer. Pre-clinical studies using PEG-ARG I have shown that it suppresses tumor cell growth and induces apoptosis in hepatocellular carcinoma; induces necrotic cell death in acute myeloid leukemia (AML) cells; induces apoptosis in ALL cells; suppresses subcutaneously-implanted melanoma in mice; induces autophagy in prostate cancer cells; induces apoptosis in pancreatic cancer cells and suppresses tumor growth in a subcutaneously-implanted pancreatic cancer murine model; and suppresses the growth of mesothelioma cells and induces apoptosis in mesothelioma cells in vivo. A clinical trial investigating the use of PEGylated arginase I in the treatment of hepatocellular carcinoma showed that the drug was well tolerated, with no neutralizing antibodies being detected in the sera of patients (Fung and Chan (2017) Journal of Hematology & Oncology 10:144).

Cytokines and Chemokines

In some embodiments, the viruses herein can be engineered to express cytokines to stimulate the immune system, including, but not limited to, GM-CSF, IL-2, IL-7, IL-10, IL-12, IL-15, IL-18, IL-21, IFN-γ, IFN-α, IFN-β, TNF-α, and TGF-B.

Cytokines stimulate immune effector cells and stromal cells at the tumor site, and enhance tumor cell recognition by cytotoxic cells. In some embodiments, the viruses can be engineered to express chemokines, such as, for example, RANTES, CCL2, CCL5, CCL19 and CXCL11. Chemokines are involved in the migration of immune cells to sites of inflammation, as well as in the maturation of immune cells and in the generation of adaptive immune responses.

GM-CSF

Granulocyte-macrophage colony-stimulating factor (GM-CSF) has been used in the treatment of cancer, for example, in cancer vaccines such as Sipuleucel-T (for prostate cancer). Oncolytic viruses expressing GM-CSF, such as talimogene laherparepvec (T-VEC, Imlygic®) and JX-594, also have shown results in the treatment of cancer. Single agent GM-CSF exhibits antitumor activity in melanoma, following direct injection into metastatic lesions. GM-CSF promotes the differentiation of monocytes to DCs, facilitating antigen presentation on DC surfaces after viral-induced oncolysis, and resulting in the recruitment of NK cells and induction of tumor-specific cytotoxic T cells (Meyers et al. (2017) *Front. Oncol.* 7:114; Lee, S. and Margolin, K. (2011) *Cancers* 3:3856-3893).

Interleukins (ILs)

Interleukin-2 (IL-2), which was the first cytokine approved for the treatment of cancer, is implicated in the activation of the immune system by several mechanisms, including the activation and promotion of CTL growth, the generation of lymphokine-activated killer (LAK) cells, the promotion of Treg cell growth and proliferation, the stimulation of TILs, and the promotion of T cell, B cell and NK cell proliferation and differentiation. Recombinant IL-2 (rIL-2) is FDA-approved for the treatment of metastatic renal cell carcinoma (RCC) and metastatic melanoma (Sheikhi et al. (2016) *Iran J. Immunol.* 13 (3): 148-166).

IL-10 is a cytokine that results in the inhibition of secretion of proinflammatory cytokines such as IFNγ, TNFα, IL-1ß and IL-6, and the inhibition of expression of MHC molecules and co-stimulatory molecules, which results in the inhibition of T cell function. Studies have shown that IL-10 induces the activation and proliferation of CD8, resulting in an antitumor effect. Studies using AM0010, a PEGylated recombinant human IL-10, in combination with pembrolizumab (anti-PD-1 antibody) in melanoma patients (Marin-Acevedo et al. (2018) *Journal of Hematology & Oncology* 11:39).

IL-12, which is secreted by antigen-presenting cells, promotes the secretion of IFN-γ by NK and T cells, inhibits tumor angiogenesis, results in the activation and proliferation of NK, $CD8^+$ T cells and $CD4^+$ T cells, enhances the differentiation of $CD4^+$Th0 cells into Th1 cells, and promotes antibody-dependent cell-mediated cytotoxicity (ADCC) against tumor cells (Sheikhi et al. (2016) *Iran J. Immunol.* 13(3): 148-166). IL-12 has been shown to exhibit antitumor effects in murine models of melanoma, colon carcinoma, mammary carcinoma and sarcoma (Lee, S. and Margolin, K. (2011) *Cancers* 3:3856-3893).

IL-15 enhances antitumor immunity by activating NK and $CD8^+$ T cells and induces long-term antitumor immunity by activating memory T cells. (Sheikhi et al. (2016) *Iran J. Immunol.* 13 (3): 148-166).

IL-21, which is produced by activated CD4+ T cells, promotes the proliferation of $CD4^+$ and $CD8^+$ T cells and enhances $CD8^+$ T cell and NK cell cytotoxicity. IL-21 has demonstrated antitumor effects in murine models of melanoma (Lee, S. and Margolin, K. (2011) *Cancers* 3:3856-3893).

Interferons (IFNs)

Type I interferons (IFNs), including IFN-α and IFN-β, are secreted by almost all cell types and are potent immunomodulators with anti-proliferative and pro-apoptotic effects on tumors. Type I IFNs induce the expression of MHC class I molecules on tumor cell surfaces, mediate DC maturation, activate cytotoxic T lymphocytes (CTLs), NKs and macrophages, can have anti-angiogenic effects on tumor neovasculature, and can exert cytostatic and apoptotic effects on tumor cells (Lee, S. and Margolin, K. (2011) *Cancers* 3:3856-3893).

IFN-α (Intron®/Roferon®-A) is approved for the treatment of hairy cell leukemia, malignant melanoma, AIDS-related Kaposi's sarcoma, and follicular non-Hodgkin's lymphoma, and is also used in the treatment of chronic myelogenous leukemia (CML), renal cell carcinoma, neuroendocrine tumors, multiple myeloma, non-follicular non-Hodgkin's lymphoma, desmoid tumors and cutaneous T-cell lymphoma.

IFN-γ, a type II IFN, is secreted by NK cells, NKT tells, CD4+ T cells, CD8+T cells, APCs and B cells. IFN-γ activates macrophages, induces the expression of MHC class I and II molecules on APCs, promotes Th1 differentiation of CD4+ T cells and activates the JAK/STAT signaling pathway. Additionally, IFN-γ has anti-angiogenic properties, has been shown to be cytotoxic to some malignant cells, and can regulate the anti-tumor activities mediated by other cytokines, such as IL-2 and IL-12 (Lee, S. and Margolin, K. (2011) *Cancers* 3:3856-3893).

TNF-α

Tumor necrosis factor alpha (TNF-α) is produced by activated macrophages, T cells and NK cells and exhibits antitumor activity via the induction of apoptosis by binding to tumor cell surface receptors, the blocking of T-Reg cells and the activation of macrophages and NK cells, the disruption of tumor vasculature and prevention of angiogenesis, the attraction and stimulation of neutrophils and monocytes, the promotion of tumor associated macrophages to the M1 antitumor stage, and the downregulation of IL-13 expression by eosinophilic-like cells and inhibition of tumor induced monocyte differentiation to immunosuppressive phenotypes. Clinical trials using systemically administered TNF-α were limited by dose-limiting toxicities, but studies in which TNF-α was administered intratumorally have been successful in the treatment of Kaposi's sarcoma and liver metastases, for example (Josephs et al. (2018) *J. Transl. Med.* 16:242).

TGF-β

TGF-β is a cytokine that can promote the differentiation of inflammatory T cells such as T-helper 17 (Th17), Th9 and resident memory T cells (Trm), and promotes the survival of CD4+ and CD8+ T cells (Dahmani and Delisle (2018) *Cancers* 10, 194).

Bi-specific T cell engagers (BiTEs®)

Bi-specific T cell engager (BiTE®) constructs are a class of artificial bispecific monoclonal antibodies that are used in cancer immunotherapy, and are formed by linking two single chain variable fragments (scFv), such that one scFV binds CD3 on the surface of cytotoxic T cells and the other binds a specific tumor-associated antigen. BiTEs® thus target T cells to tumor cells, stimulating T cell activation, cytokine production and tumor cell cytotoxicity independently of MHC class I or co-stimulatory molecules. BiTEs® in clinical trials include blinatumomab (MT-103), which is being investigated for the treatment of non-Hodgkin's lymphoma and acute lymphoblastic leukemia, and is directed towards CD19; solitomab (MT110), which is being investigated for the treatment of gastrointestinal and lung cancers and is directed towards the EpCAM antigen; MT-111, which targets carcinoembryonic antigen (CEA) and is being investigated in the treatment of gastrointestinal adenocarcinoma; and BAY2010112 (AMG112), which targets prostate-specific membrane antigen (PSMA) and is being investigated for the treatment of prostate cancer. Catumaxomab (Removab®) is a bi-specific rat-mouse hybrid monoclonal antibody which targets CD3 and EpCAM and is used in the treatment of malignant ascites. Other BiTE®s in development include those targeting EGFR, EphA2, Her2, ADAM17/TACE, prostate stem cell antigen (PSCA) and melanoma-associated chondroitin sulfate proteoglycan (MCSP) (Huehls et al. (2015) *Immunol. Cell Biol.* 93 (3): 290-296).

Tumor-associated Antigens and Tumor neo-antigens

Tumor-associated antigens (TAA), which can be targeted by cancer vaccines, are overexpressed in tumor cells, but also are expressed by normal tissues. As a result, therapies targeting TAAs can result in low therapeutic efficiency, central and peripheral immunotolerance and autoimmunity. Tumor-specific neo-antigens, on the other hand, are derived from random somatic mutations in tumor cells and are not found in non-cancerous cells. Cancer vaccines targeting tumor neo-antigens thus have potential for increased specificity, efficacy and safety, and have demonstrated results pre-clinically and in early-phase clinical studies in the treatment of several types of cancer, including melanoma, pancreatic cancer, colorectal cancer, sarcomas, breast cancer and lung cancer (Guo et al. (2018) *Front. Immunol.* 9:1499; Bendjama and Quemeneur (2017) *Human Vaccines & Immunotherapeutics* 13 (9): 1997-2003). Neo-antigen-based vaccines include peptide-based, nucleic acid (mRNA/DNA) based, human cell-based (e.g., in-vitro/ex-vivo pulsed dendritic cells) and live vector-based (viral or bacterial) vaccines. Live vectors present an attractive delivery system that can more efficiently target antigen-presenting cells (APCs) and are easier and less costly to prepare than dendritic cell-based vaccines. For example, attenuated forms of *Listeria monocytogenes* have been developed by Advaxis (Princeton, NJ) for neo-antigen vaccine delivery. Adenoviruses (e.g., Exovax; NousCom, Basel, Switzerland), aviruses, poxviruses and lentiviruses (e.g., ZVex®; ImmuneDesign, Seattle, WA) also have been used for the delivery of neo-antigen vaccines. Poxviruses, such as Modified Virus Ankara (MVA), have a large genome that is amenable to genetic manipulation and enables the insertion of a large number of protein antigens. For example, MVA-based vaccines include TG4001 (Tipapkinogene sovacivec), which targets the E6 and E7 antigens from human papilloma virus and was used to treat high-grade cervical intraepithelial neoplasia. Other MVA-based tumor neo-antigen vaccines include TG4010 (Mesmulogene ancovacivec), which was successful in the treatment of non-small cell lung cancer, and Prostvac® (Rilimogene galvacirepvec), which expresses prostate specific antigen (PSA), in addition to stimulating cytokines (LFA-3, ICAM-1 and B7.1), and has shown results in the treatment of prostate cancer (Bendjama and Quemeneur (2017) *Human Vaccines & Immunotherapeutics* 13 (9): 1997-2003).

Viruses described and provided herein can encode tumor-associated antigens (TAA) or tumor-specific antigens (neo-antigens), including, but not limited to, for example, alphafetoprotein (AFP), carcinoembryonic antigen (CEA), CA-125, MUC-1, cancer testis antigens (CTAs), New York esophageal squamous cell carcinoma-1 (NY-ESO-1), E6/E7, SV40, MART-1, PRAME, CT83, SSX2, BAGE family, CAGE family, epithelial tumor antigen (ETA), prostate specific antigen (PSA), prostate specific membrane antigen (PSMA), melanoma-associated antigens (MAGEs), TACE/ADAM17, tyrosinase, CD19, GP100, telomerase, cyclin B1, survivin, mesothelin, EPHA2, B-cell maturation antigen (BMCA), and HER2.

Angiogenesis Inhibitors/Tumor Blood Vessels Reprogramming/Vascular Normalization In some embodiments, the viruses provided herein can encode angiogenesis inhibitors (for tumor blood vessels reprogramming, e.g.). Angiogenesis is a well-known contributor to the progression of cancer, and angiogenesis inhibitors, particularly when used in combination with other anti-cancer therapies, can be used to prevent the formation of new blood vessels during cancer therapy, thereby blocking the supply of nutrients and/or oxygen to the tumor. Proteins that act as angiogenesis activators, and can be targeted by angiogenesis inhibitors, include vascular endothelial growth factor (VEGF; e.g., (VEGFA, VEGFB), vascular endothelial growth factor receptor (VEGFR2), basic fibroblast growth factor (bFGF, FGF2), angiogenin, transforming growth factor (TGF)-α, TGF-β, tumor necrosis factor (TNF)-a, platelet derived endothelial growth factor, granulocyte colony-stimulating factor (GM-CSF), interleukin-8 (IL-8), hepatocyte growth factor (HGF), angiopoietin (e.g., ANGPT-1, ANGPT-2), placental-derived growth factor (PDGF) and PDGF receptor (PDGFRa), and epidermal growth factor (EGF) (Rajabi, M. and Mousa, S.A. (2017) *Biomedicines* 5, 34; Kong et al. (2017) *Int. J. Mol. Sci.* 18, 1786).

Studies indicate that in addition to blocking blood vessel formation, cancer immunotherapy using angiogenesis inhibitors can be enhanced by their effects on stabilizing and/or normalizing tumor vasculature (such doses can sometimes be lower than doses that block blood vessel formation) (see, e.g., Huang et al., *Cancer Res.,* 73(10):2943-2948 (2013); Matuszewska et al., *Clin. Cancer Res.,* 25 (5): 1624-1638 (2019); Lanitis et al, *Curr. Opin. Immunol.,* 33:55-63 (2015); and Bykov et al., *Clin. Cancer Res.,* 25 (2): 1446-1448 (2019), the contents of which are incorporated in their entirety by reference herein). To meet oxygen and nutrient demands, tumors initiate a version of angiogenesis by secreting factors such as VEGF in response to hypoxia, oncogenes and the loss of tumor suppressor genes. The resulting blood vessels are marked by structural abnormalities such as irregular branching, loss of basement membrane integrity, and inadequate or absent perivascular cells, leading to inefficiencies in the delivery of cancer therapies to the tumor core. In addition, the limited vascular perfusion in the tumors selects for hypoxia and acidity in the tumor microenvironment, which can limit the effectiveness of a therapeutic agent and exacerbate metastasis. (see, e.g., Matuszewska et al., *Clin. Cancer Res.,* 25 (5): 1624-1638 (2019), and references cited therein). Furthermore, endothelial cells lining the vessels can suppress T cell activity, target them for destruction and block them from gaining entry into the tumor through the deregulation of adhesion molecules (Lanitis et al, *Curr. Opin. Immunol.,* 33:55-63 (2015).

Recent studies have demonstrated that the efficacy of OV (oncolytic virus) therapy can be increased by downregulating/inhibiting angiogenesis and/or upregulating anti-angiogenesis. While the administration of OV therapy as a single agent can be effective at reducing tumor growth, administration of the virus initiates a vascular shutdown. Previously, the shutdown was viewed as a potential benefit that maximized direct oncolysis by facilitating sequestering of the virus. However, OV therapy often is administered in multiple doses for optimum efficacy; when vascular disruption is induced, it can impair the uptake of subsequent doses of the OV. In addition, the delivery of immune cells to the tumor site can become impaired. (see, e.g., Matuszewska et al., *Clin. Cancer Res.,* 25 (5): 1624-1638 (2019), and references cited therein). Matuszewska et al. (*Clin. Cancer Res.,* 25 (5): 1624-1638 (2019) found that in an in vivo mouse model of ovarian cancer, co-administering an oncolytic virus (NDV; Newcastle Disease Virus) with 3TSR protein, an anti-angiogenic protein, led to enhanced tumor perfusion, with normalization of vascular structure and reduction of hypoxia within the tumor, which in turn resulted in improved reduction in primary tumor growth, ascites and metastases when compared to either treatment alone.

The CAVES compositions and related methods of use and treatment provided herein can include viruses that encode molecules that inhibit angiogenesis, including those that downregulate pro-angiogenic factors and/or upregulate anti-angigenic factors. Alternately, or, in addition, the CAVES compositions provided herein can be administered in combination with angiogenesis inhibitors. The angiogenesis inhibitors can induce vascular normalization, repairing tumor vasculature (tumor blood vessel reprogramming) by restoring balance in the cascade of signals initiated by the interplay of tumor cells with their local cellular environment.

Direct inhibitors of angiogenesis, which target the endothelial cells in the growing vasculature, include angiostatin, endostatin, arrestin, canstatin and tumstatin. Indirect angiogenesis inhibitors, which target tumor cells or tumor-associated stromal cells, act by blocking the expression or activity of pro-angiogenic proteins. For example, gefitinib is a small molecule EGFR tyrosine kinase inhibitor (TKI) used in the treatment of colon, breast, ovarian and gastric cancers. Bevacizumab (Avastin®), is a recombinant humanized monoclonal antibody against VEGF, which blocks tumor-derived VEGF-A, preventing the development of new blood vessels and resulting in tumor growth inhibition. Other angiogenesis inhibitors include thalidomide (Immunoprin), imatinib, lenalidomide, sorafenib (Nexavar®), sunitinib, axitinib (Inlyta®), temsirolimus (Torisel®), pazopanib, cabozantinib, everolimus, ramucirumab (Cyramza®), regorafenib, vandetanib, tanibirumab, olaratumab (Lartruvo®), nesvacumab, AMG780, MEDI3617, vanucizumab, rilotumumab (AMG102), ficlatuzumab, TAK-701, onartuzumab (MetMab), emibetuzumab and aflibercept (Eylea, Zaltrap®) (Rajabi, M. and Mousa, S.A. (2017) *Biomedicines* 5, 34; Kong et al. (2017) *Int. J. Mol. Sci.* 18, 1786).

VEGF is a potent angiogenic activator in neoplastic tissues and plays an important role in tumor angiogenesis. For example, studies have shown that: VEGF receptors (VEGFRs) are expressed in leukemia, non-small cell lung cancer (NSCLC), gastric cancer and breast cancer; higher levels of VEGF mRNA are correlated with decreased 5-year survival rates in NSCLC; VEGF-A expression in breast cancer promotes proliferation, survival and metastasis of breast cancer cells; and VEGF-A and VEGF-C overexpression in gastric cancer is associated with poor prognosis, while silencing of VEGF-A and VEGF-C significantly inhibits proliferation and tumor growth. Bevacizumab (Avastin®), which is a recombinant humanized immunoglobulin G (IgG) antibody that inhibits the formation of the VEGF-A and VEGFR-2 complex, was approved by the FDA in 2004 for the treatment of metastatic colorectal cancer in combination with chemotherapy, and is used to treat various other cancers, including metastatic non-squamous NSCLC, metastatic renal cell carcinoma, breast cancer, epithelial ovarian cancer and glioblastoma. Aflibercept (Zaltrap®) is an Fc fusion protein that inhibits the activity of VEGF-A, VEGF-B and P1GF, and was FDA-approved in 2012 for the treatment of metastatic colorectal cancer that is resistant to, or has progressed following treatment with oxaliplatin. Ramucirumab (Cyramza®) is a fully human monoclonal antibody that inhibits the interaction of VEGFR-2 with VEGF ligands, and was FDA-approved in 2014 for the treatment of advanced gastric or gastro-esophageal junction adenocarcinoma and metastatic NSCLC. Tanibirumab is a fully human monoclonal antibody that binds VEGFR-2, blocking its interaction with ligands such as VEGF-A, VEGF-C and VEGF-D (Kong et al. (2017) *Int. J. Mol. Sci.* 18, 1786).

In addition to promoting tumor angiogenesis, VEGF is immunosuppressive and can inhibit the function of T cells, increase the recruitment of Tregs and MDSCs, and prevent the differentiation, maturation and activation of DCs. VEGFA was found to enhance the expression of inhibitory checkpoints such as PD-1, CTLA-4, TIM-3 and LAG-3, which was reversed by antibodies against VEGFR2. Thus, antitumor immunity can be enhanced by targeting VEGF/VEGFR. For example, targeting VEGF/VEGFR has been shown to promote T-cell infiltration in the TME. Therapy with bevacizumab was found to increase B and T cell compartments in patients with metastatic colorectal cancer, and improve cytotoxic T-lymphocyte responses in patients with metastatic NSCLC. Bevacizumab was also found to increase the number of DCs and promote their activation. Axitinib, a small molecule inhibitor of VEGFR1, VEGFR2 and VEGFR3, was found to reduce the number and suppressive capacity of MDSCs, and induce differentiation of MDSCs toward an antigen-presenting phenotype. Sorafenib, a multikinase inhibitor that targets VEGFR2, VEGFR3 and PDGFRB, among others, was found to restore the differentiation of DCs. Sunitinib, a tyrosine kinase inhibitor that blocks VEGFR1, VEGFR2, VEGFR3, platelet-derived growth factor receptors a and B, stem cell factor receptor and Flt3, was found to reduce expression of IL-10, Foxp3, PD-1, CTLA-4 and BRAF, increase the proportion of CD4+ and CD8+TILs, reduce the number of Tregs, and increase cytotoxic T cell activity against tumor cells in mice. Sunitinib also was found to decrease the number of MDSCs in various tumor models. Thus, sunitinib can be used to modify the TME, altering cytokine and costimulatory molecule expression profiles and resulting in favorable T-cell activation and Th1 responses. Sunitinib in combination with an oncolytic reovirus was shown to significantly decrease tumor burden and increase the lifespan in a pre-clinical murine model of renal cell carcinoma, while the combination of sunitinib with an oncolytic VSV was found to eliminate prostate, breast and kidney malignant tumors in mice (Meyers et al. (2017) *Front. Oncol.* 7:114; Yang et al. (2018) *Front. Immunol.* 9:978). These results indicate that combination therapy that includes angiogenesis inhibitors with oncolytic viruses can improve anti-cancer therapeutic efficacy.

PDGF/PDGFR signaling is associated with angiogenesis, tumor growth and decreased patient survival, with PDGFR and/or PDGF overexpression being observed in colorectal cancer, prostate cancer and glioblastomas, for example. Small molecules that target PDGFRs include imatinib, sunitinib, regorafenib and pazopanib, which inhibit the activation of PDGFRs and other kinases, such as VEGFR and FGFR. These molecules have been approved for the treatment of metastatic colorectal cancer, metastatic renal cell carcinoma and gastrointestinal stromal tumors. Antibodies targeting PDGF and PDGFR include olaratumab (Lartruvo™), which targets PDGFRα and has been approved by the FDA for the treatment of soft tissue sarcoma (Kong et al. (2017) *Int. J. Mol. Sci.* 18, 1786).

Hepatocyte growth factor (HGF), a motility and morphogenic factor, interacts with c-MET and results in various biological responses, such as embryonic development, epithelial branching morphogenesis, wound healing and tumor development. HGF/c-MET signaling is thus a target for cancer therapy. Rilotumumab, a fully human monoclonal antibody, binds HGF, blocking its interaction with c-MET, and resulting in anti-tumor effects such as tumor growth inhibition, tumor regression, apoptosis and abrogation of cell proliferation. Other humanized monoclonal antibodies against HGF include ficlatuzumab and TAK-701 (L2G7), while humanized monoclonal antibodies against c-MET include onartuzumab (MetMab) and emibetuzumab (LY-2875358) (Kong et al. (2017) *Int. J. Mol. Sci.* 18, 1786).

Other Therapeutic Antibodies

Monoclonal antibodies can be used to target antigens expressed by cancer cells for cancer therapy. In certain embodiments, the viruses herein can be engineered to express other therapeutic anti-cancer antibodies, in addition to the angiogenesis inhibitors, BiTEs, and immune checkpoint inhibitors/stimulators discussed above, including, for example, humanized or chimeric monoclonal antibodies, such as, but not limited to alemtuzumab (Campath®; anti-CD52), trastuzumab (Herceptin®; anti-HER2), cetuximab (Erbitux®; anti-EGFR), panitumumab (Vectibix®; anti-EGFR), ofatumumab (Arzerra®; anti-CD20), rituximab (Rituxan®/MabThera®; anti-CD20), gemtuzumab ozogamicin (Mylotarg®; anti-CD33), brentuximab vedotin (Adcetris®; anti-CD30), tositumomab (anti-CD20), daratumumab (Darzalex®; anti-CD38); dinutuximab (Unituxin®; anti-GD2); elotuzumab (Empliciti™; anti-SLAMF7); necitumumab (Portrazza™; anti-EGFR); obinutuzumab (Gazyva®; anti-CD20); and pertuzumab (Perjeta®; anti-HER2).

Monoclonal antibodies have been successful in the treatment of several types of cancers, alone and in combination therapies. For example, rituximab, also known as IDEC-C2BB, was the first monoclonal antibody to be approved by the FDA, and is used for the treatment of non-Hodgkin's lymphoma and chronic lymphocytic leukemia. Trastuzumab is an FDA-approved monoclonal antibody used to treat $HER2^+$ breast cancer. Additionally, cetuximab is used in the treatment of colorectal cancer, metastatic NSCLC and head and neck cancer; panitumumab is used to treat metastatic colorectal cancer; alemtuzumab is used to treat chronic lymphocytic leukemia (CLL), cutaneous T-cell lymphoma and T-cell lymphoma; ofatumumab is used in the treatment of CLL; gemtuzumab ozogamicin is used in the treatment of acute myeloid leukemia; brentuximab vedotin is used in the treatment of relapsed or refractory Hodgkin's lymphoma, systemic anaplastic large cell lymphoma and cutaneous T-cell lymphoma; tositumomab, in combination with iodine-labeled tositumomab (Bexxar), is used in the treatment of chemotherapy and rituximab-refractory Non-Hodgkin's lymphoma; daratumumab is used in the treatment of multiple myeloma, diffuse large B cell lymphoma, follicular lymphoma and mantle cell lymphoma; dinutuximab is used in the treatment of pediatric neuroblastoma; elotuzumab is used in the treatment of multiple myeloma; necitumumab is used in the treatment of metastatic squamous NSCLC; obinutuzumab is used in the treatment of chronic lymphocytic leukemia and follicular lymphoma; and pertuzumab is used in the treatment of $HER2^+$ breast cancer.

Other antibodies include D1 (A12), which targets the TACE ectodomain, and was shown to inhibit the proliferation and motility of cancer cells in head and neck squamous cell carcinoma; Fsn0503h, an antibody against Cathepsin S, which has been shown to suppress angiogenesis and metastases in vivo; and ATN-658, an antibody against urokinase plasminogen activator receptor (uPAR), which has been shown to inhibit invasion, metastasis and tumor proliferation and induce apoptosis (Neves and Kwok (2015) *BBA Clinical* 3:280-288).

Reporter Genes

In certain embodiments, the viruses can be engineered to express reporter genes, including imaging molecules/agents, such as, for example, fluorescent proteins (for example, GFP, YFP, RFP, TurboFP635); luminescent proteins (for example, luciferase); and magnetic resonance, ultrasound or tomographic imaging agents, including radionuclides. The viruses herein also can be engineered to express human sodium iodide symporter (hNIS) or aquaporin 1 (AQP1), which facilitate the detection of viruses via deep tissue non-invasive imaging techniques, such as PET, SPECT/CT, γcamera or MRI.

NIS

The $Na^+/I^-$ symporter (NIS) is a transmembrane glycoprotein that mediates the transport of iodide anions into cells, for example, in the thyroid and other tissues, such as salivary glands, the stomach, kidneys, placenta, lactating mammary glands and small intestine. Radioisotopes such as $^{123}I$, $^{124}I$, $^{125}I$, $^{131}I$ and $^{99m}Tc$ are transported via NIS, which, when encoded by the virus, is expressed on the surface of infected cells, allowing for non-invasive imaging, using, for example, PET, SPECT/CT, and γcamera (Msaouel et al. (2013) *Expert Opin. Biol. Ther.* 13 (4)).

NIS is useful as a reporter gene because it accumulates radiolabeled substrates, concentrating and amplifying the signal, can be used to monitor the delivery of other genes and, upon expression in the tumor, can be used to monitor tumor size using diagnostic scintigraphic imaging. For example, adenovirus expressing human NIS (hNIS) has been delivered intranasally into the lungs of rats, and an 124T PET signal was detectable for up to 17 days following administration. A lentiviral vector expressing NIS was used to detect transplanted rat cardiac-derived stem cells with single-photon emission computed tomography (PET) imaging using $^{99m}TcO_4^-$ or $^{124}I^-$ (Portulano et al. (2014) *Endocr. Rev.* 35 (1): 106-149).

NIS-expressing viruses can be used to combine oncolytic and radiation therapies, which has been shown to enhance oncolytic efficacy pre-clinically. For example, an adenoviral vector expressing NIS under a CMV promoter was injected into the portal vein of hepatocarcinoma-bearing rats, and following $^{131}I^-$ therapy, potent inhibition of tumor growth and prolonged survival were observed. Administration of an adenoviral vector expressing NIS under the MUC1 promoter to mice with pancreatic carcinoma resulted in significant tumor regression following $^{131}I^-$ treatment (Portulano et al. (2014) *Endocr. Rev.* 35(1): 106-149). Vaccinia virus encoding the human NIS gene (VV-NIS) has been studied for the treatment and monitoring of endometrial cancer, pancreatic cancer, malignant pleural mesothelioma, colorectal cancer, anaplastic thyroid cancer, prostate cancer and gastric cancer. VV-NIS also has been used as a reporter gene to identify positive surgical margins of breast cancer in a murine model with 1241-microPET imaging (Ravera et al. (2017) *Annu Rev Physiol.* 79:261-289).

Oncolytic measles virus (MV) expressing NIS (MV-NIS) for radio-virotherapy with I-131 also has demonstrated results pre-clinically in multiple myeloma, glioblastoma multiforme, head and neck cancer, anaplastic thyroid cancer, ovarian cancer, pancreatic cancer, mesothelioma, hepatocellular carcinoma, osteosarcoma, endometrial cancer and prostate cancer models. Several Phase I/II clinical trials have investigated the use of MV-NIS in multiple myeloma (NCT00450814, NCT02192775), mesothelioma (NCT01503177), head and neck cancer (NCT01846091) and in ovarian cancer using virus-infected MSCs (NCT02068794).

Aquaporin 1 (AQP1)

Aquaporins are integral membrane proteins that mediate the transport of water across the plasma membrane in cells. Human aquaporin 1 (AQP1) can be used as a genetically encoded reporter for diffusion-weighted MRI, and is advantageous due to its non-toxicity, metal-free nature, and sensitivity. Because it is an autologous reporter gene, there is no risk of immunogenicity. Studies have shown that AQP1 enables gene expression imaging in tumor xenografts (Mukherjee et al. (2016) *Nature Communications* 7:13891).

C. Generation, Formulation, Storage and Transportation of CAVES

The CAVES systems provided herein can be generated by incubating any of the carrier cells provided herein, including modified carrier cells, with any of the oncolytic viruses provided herein, including modified viruses, such as those engineered to express a recombinant therapeutic protein, at a time and temperature suitable for loading of the cells, infection, and replication of the virus such that at least one virus-encoded immunomodulatory protein and/or recombinant therapeutic protein is expressed. In embodiments, the incubation time can be longer than that required to express the virus-encoded immunomodulatory and/or recombinant therapeutic protein, e.g., the time required to generate progeny virus particles, including EEV particles. The incubation temperature can be, e.g., room temperature or 32-42° C., e.g., 35-40° C. In embodiments, the incubation temperature is 37° C. Loading of the virus onto the cells can be at an MOI of 0.001 to 200, 300, 400 or 1000 or more. In embodiments, the MOI is about 0.001-10, e.g., 0.01-1.0, or an MOI of 1.0.

Generation of the CAVES generally requires incubation times of more than 2 hours, generally between about 3 hours and 72 or more hours, for example generally at least or between about 3, 4, 5 or 6 hours or between greater than about 4 hours to at least or between about 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 or more hours, for example between about 6 hours to 18 hours, or between about 12 hours to 48 hours. The time and the temperature to facilitate such expression can depend on the type of oncolytic virus and/or cell, such as a carrier cell, or a combination thereof, used in the system. For example, in the VSV viral replication cycle, the time taken to express a virus-encoded immunomodulatory protein and/or a recombinant protein, such as a therapeutic protein, generally is relatively short, of the order of 2-3 hours, whereas in the case of vaccinia virus, the time taken to express a virus-encoded immunomodulatory protein and/or recombinant therapeutic protein generally is longer, of the order of 6-12 hours or more. In embodiments where the oncolytic virus is vaccinia, the incubation times can be at least or between about 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 or more hours, for example between about 6 hours to 18 hours, or between about 12 hours to 48 hours or about 30-36 hours. In some embodiments, the vaccinia virus is ACAM2000 having the sequence set forth in SEQ ID NO:70. In other embodiments, the vaccinia virus is CAL1 having the sequence set forth in SEQ ID NO:71. In some embodiments in which the oncolytic virus is a vaccinia virus, such as ACAM2000 having the sequence set forth in SEQ ID NO:70 or CAL1 having the sequence set forth in SEQ ID NO: 71, the carrier cell is a stem cell or cell derived from SVF, such as a MSC, a SA-ASC or pericyte.

The systems provided herein can stably and indefinitely be stored frozen or under cryopreservation (e.g.,-20 to −80° C.) and can be thawed as desired prior to administration. For example, the systems provided herein can be stored at −80° C. for at least or between about a few hours, e.g., 1, 2, 3, 4 or 5 hours, to at least or between about a few years, e.g., 1, 2, 3 or more years, for example for at least or about 1, 2, 3, 4 or 5 hours to at least or about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 hours or 4, 5, 6, 7, 8, 9, 10, 15, 20, 25 or 30 days or 1.5, 2, 2.5, 3, 3.5, 4, 4.5, 5, 5.5, 6, 6.5, 7, 7.5, 8, 8.5, 9, 9.5, 10, 10.5, 11, 11.5 or 12 months or 1, 2, 3, 4 or 5 or more years prior to thawing for administration. The systems provided herein also can stably be stored under refrigeration conditions e.g., from 0-5° C., e.g., 4° C. and/or transported on ice to the site of administration for treatment. For example, the systems provided herein can be stored at 4° C. or on ice for at least or between about a few hours, e.g., 1, 2, 3, 4 or 5 hours, to at least or about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 or more hours prior to administration for treatment.

D. Pharmaceutical Compositions, Combinations and Kits

Provided herein are pharmaceutical compositions, combinations and kits containing the CAVES systems provided herein. Pharmaceutical compositions can include CAVES containing any of the carrier cells and any of the oncolytic viruses provided herein, and a pharmaceutical carrier. The pharmaceutical compositions can be at room temperature to about 37° C., at refrigeration temperatures e.g., from 0-5° C., e.g., 4° C., or under freezing or cryopreservation conditions, e.g.,-20 to −80° C. In embodiments, the pharmaceutical compositions are at −80° C. Combinations can include, for example, a carrier cell, an oncolytic virus; and at least one immunomodulatory and/or recombinant therapeutic protein encoded by the oncolytic virus. Combinations can include any of the carrier cells provided herein, an oncolytic virus, a virus-encoded immunomodulatory protein and/or recombinant therapeutic protein and a detectable compound; a CAVES and an additional therapeutic compound; a CAVES and a viral expression modulating compound, or any combination thereof. Kits can include one or more pharmaceutical compositions or combinations provided herein, and one or more components, such as instructions for use, a device for administering the pharmaceutical composition or combination to a subject, a device for administering a therapeutic or diagnostic compound to a subject or a device for detecting a virus in a subject.

A carrier cell contained in a pharmaceutical composition, combination or kit can include any carrier cell provided herein. An oncolytic virus contained in a pharmaceutical composition, combination or kit can include any virus provided herein.

1. Pharmaceutical Compositions

Provided herein are pharmaceutical compositions containing a CAVES, including any of the carrier cells provided herein, the oncolytic viruses provided herein and at least one expressed virus-encoded immunomodulatory and/or recombinant therapeutic protein, and a suitable pharmaceutical carrier. A pharmaceutically acceptable carrier includes a solid, semi-solid or liquid material that acts as a vehicle carrier or medium for the virus. Pharmaceutical compositions provided herein can be formulated in various forms, for example in solid, semi-solid, aqueous, liquid, powder or lyophilized form. Exemplary pharmaceutical compositions containing any carrier cell (including primed, sensitized, engineered cells) or an oncolytic virus in the CAVES systems provided herein include, but are not limited to, sterile injectable solutions, sterile packaged powders, eye drops, tablets, pills, powders, lozenges, sachets, cachets, elixirs, suspensions, emulsions, solutions, syrups, aerosols (as a solid or in a liquid medium), ointments, soft and hard gelatin capsules, and suppositories.

Examples of suitable pharmaceutical carriers are known in the art and include, but are not limited to, water, buffers, saline solutions, phosphate buffered saline solutions, various types of wetting agents, sterile solutions, alcohols, gum arabic, vegetable oils, benzyl alcohols, gelatin, glycerin, carbohydrates, such as lactose, sucrose, dextrose, amylose or starch, sorbitol, mannitol, magnesium stearate, talc, silicic acid, viscous paraffin, perfume oil, fatty acid monoglycerides and diglycerides, pentaerythritol fatty acid esters, hydroxy methylcellulose, and powders, among others. Pharmaceutical compositions provided herein can contain other additives including, for example, antioxidants, preserving agents, analgesic agents, binders, disintegrants, coloring, diluents, excipients, extenders, glidants, solubilizers, stabilizers, tonicity agents, vehicles, viscosity agents, flavoring agents, sweetening agents, emulsions, such as oil/water emulsions, emulsifying and suspending agents, such as acacia, agar, alginic acid, sodium alginate, bentonite, carbomer, carrageenan, carboxymethylcellulose, cellulose, cholesterol, gelatin, hydroxyethyl cellulose, hydroxypropyl cellulose, hydroxypropyl methylcellulose, methylcellulose, octoxynol 9, oleyl alcohol, povidone, propylene glycol monostearate, sodium lauryl sulfate, sorbitan esters, stearyl alcohol, tragacanth, xanthan gum, and derivatives thereof, solvents, and miscellaneous ingredients, such as, but not limited to, crystalline cellulose, microcrystalline cellulose, citric acid, dextrin, liquid glucose, lactic acid, lactose, magnesium chloride, potassium metaphosphate, starch, among others. Such carriers and/or additives can be formulated by conventional methods and can be administered to the subject at a suitable dose. Stabilizing agents such as lipids, nuclease inhibitors, polymers, and chelating agents can preserve the compositions from degradation within the body. Other suitable formulations for use in a pharmaceutical composition can be found, for example, in *Remington: The Science and Practice of Pharmacy* (2005, Twenty-first edition, Gennaro & Gennaro, eds., Lippencott Williams and Wilkins).

Pharmaceutical formulations that include a CAVES system provided herein for injection or mucosal delivery typically include aqueous solutions of the virus provided in a suitable buffer for injection or mucosal administration or lyophilized forms of the virus for reconstitution in a suitable buffer for injection or mucosal administration. Such formulations optionally can contain one or more pharmaceutically acceptable carriers and/or additives as described herein or known in the art. Liquid compositions for oral administration generally include aqueous solutions, suitably flavored syrups, aqueous or oil suspensions, and flavored emulsions with edible oils such as corn oil, cottonseed oil, sesame oil, coconut oil, or peanut oil, as well as elixirs and similar pharmaceutical vehicles.

Pharmaceutical compositions provided herein can be formulated to provide quick, sustained or delayed released of a CAVES system as described herein by employing procedures known in the art. For preparing solid compositions such as tablets, a CAVES system provided herein is mixed with a pharmaceutical carrier to form a solid composition. Optionally, tablets or pills are coated or otherwise compounded to provide a dosage form affording the advantage of prolonged action in the subject. For example, a tablet or pill contains an inner dosage and an outer dosage component, the latter being in the form of an envelope over the former. The two components can be separated by an enteric layer, for example, which serves to resist disintegration in the stomach and permit the inner component to pass intact into the duodenum or to be delayed in release. A variety of materials are used for such enteric layers or coatings, including, for example, a number of polymeric acids and mixtures of polymeric acids with such materials as shellac, cetyl alcohol, and cellulose acetate.

Compositions for inhalation or insufflation include solutions and suspensions in pharmaceutically acceptable, aqueous or organic solvents, or mixtures thereof, and powders. These liquid or solid compositions optionally can contain suitable pharmaceutically acceptable excipients and/or additives as described herein or known in the art. Such compositions are administered, for example, by the oral or nasal respiratory route for local or systemic effect. Compositions in pharmaceutically acceptable solvents are nebulized by use of inert gases. Nebulized solutions are inhaled, for example, directly from the nebulizing device, from an attached face mask tent, or from an intermittent positive pressure breathing machine. Solution, suspension, or powder compositions are administered, orally or nasally, for example, from devices which deliver the formulation in an appropriate manner such as, for example, use of an inhaler.

Pharmaceutical compositions provided herein can be formulated for transdermal delivery via a transdermal delivery devices ("patches"). Such transdermal patches are used to provide continuous or discontinuous infusion of a virus provided herein. The construction and use of transdermal patches for the delivery of pharmaceutical agents are performed according to methods known in the art (see, for example, U.S. Pat. No. 5,023,252). Such patches are constructed for continuous, pulsatile, or on-demand delivery of a carrier cell and/or virus provided herein.

Colloidal dispersion systems that can be used for delivery of viruses include macromolecule complexes, nanocapsules, microspheres, beads and lipid-based systems including oil-in-water emulsions (mixed), micelles, liposomes and lipoplexes. An exemplary colloidal system is a liposome. Organ-specific or cell-specific liposomes can be used in order to achieve delivery only to the desired tissue. The targeting of liposomes can be carried out by the person skilled in the art by applying commonly known methods. This targeting includes passive targeting (using the natural tendency of the liposomes to distribute to cells of the reticuloendothelial system (RES) in organs which contain sinusoidal capillaries) or active targeting (for example, by coupling the liposome to a specific ligand, for example, an antibody, a receptor, sugar, glycolipid and protein, by methods known to those of skill in the art). Monoclonal antibodies can be used to target liposomes to specific tissues, for example, tumor tissues, via specific cell-surface ligands.

2. Combinations

Provided are combinations of a carrier cell, an oncolytic virus; and at least one expressed virus-encoded immunomodulator and/or recombinant therapeutic protein. A combination can include a third or fourth agent, such as a second virus or other therapeutic or diagnostic agent. A combination can contain pharmaceutical compositions containing a CAVES system provided herein. A combination also can include any reagent for effecting treatment or diagnosis in accord with the methods provided herein such as, for example, an antiviral or chemotherapeutic agent. Combinations also can contain a compound used for the modulation of gene expression from endogenous or heterologous genes encoded by the virus.

Combinations provided herein can contain a CAVES system and a therapeutic compound. Therapeutic compounds for the compositions provided herein can be, for example, an anti-cancer or chemotherapeutic compound. Exemplary therapeutic compounds include, for example, cytokines, growth factors, photosensitizing agents, radionuclides, toxins, siRNA molecules, enzyme/pro E drug pairs, anti-metabolites, signaling modulators, anti-cancer antibiotics, anti-cancer antibodies, angiogenesis inhibitors, chemotherapeutic compounds, antimetastatic compounds or a combination of any thereof.

CAVES systems provided herein can be combined with an anti-cancer compound, such as a platinum coordination complex. Exemplary platinum coordination complexes include, for example, cisplatin, carboplatin, oxaliplatin, DWA2114R, NK121, IS3 295, and 254-S. Exemplary chemotherapeutic agents also include, but are not limited to, methotrexate, vincristine, adriamycin, non-sugar containing chloroethylnitrosoureas, 5-fluorouracil, mitomycin C, bleomycin, doxorubicin, dacarbazine, taxol, fragyline, Meglamine GLA, valrubicin, carmustine, polifeprosan, MM1270, BAY 12-9566, RAS farnesyl transferase inhibitor, farnesyl transferase inhibitor, MMP, MTA/LY231514, lometrexol/LY264618, Glamolec, CI-994, TNP-470, Hycamtin/topotecan, PKC412, Valspodar/PSC833, Novantrone/mitoxantrone, Metaret/suramin, BB-94/batimastat, E7070, BCH-4556, CS-682, 9-AC, AG3340, AG3433, Incel/VX-710, VX-853, ZD0101, IS1641, ODN 698, TA 2516/marimastat, BB2516/marimastat, CDP 845, D2163, PD183805, DX8951f, Lemonal DP 2202, FK 317, picibanil/OK-432, valrubicin/AD 32, strontium-89/Metastron, Temodal/temozolomide, Yewtaxan/paclitaxel, Taxol/paclitaxel, Paxex/paclitaxel, Cyclopax/oral paclitaxel, Xeloda/capecitabine, Furtulon/doxifluridine, oral taxoids, SPU-077/cisplatin, HMR 1275/flavopiridol, CP-358 (774)/EGFR, CP-609 (754)/RAS oncogene inhibitor, BMS-182751/oral platinum, UFT (Tegafur/Uracil), Ergamisol/levamisole, Campto/levamisole, Eniluracil/776C85/5FU enhancer, Camptosar/irinotecan, Tomudex/raltitrexed, Leustatin/cladribine, Caelyx/liposomal doxorubicin, Myocet/liposomal doxorubicin, Doxil/liposomal doxorubicin, Evacet/liposomal doxorubicin, Fludara/fludarabine, Pharmorubicin/epirubicin, DepoCyt, ZD1839, LU 79553/Bis-Naphthalimide, LU 103793/Dolastatin, Gemzar/gemcitabine, ZD 0473/AnorMED, YM 116, Iodine seeds, CDK4 and CDK2 inhibitors, PARP inhibitors, D4809/dexifosfamide, Ifex/Mesnex/ifosfamide, Vumon/teniposide, Paraplatin/carboplatin, Platinol/cisplatin, VePesid/Eposin/Etopophos/etoposide, ZD 9331, Taxotere/docetaxel, prodrugs of guanine arabinoside, taxane analogs, nitrosoureas, alkylating agents such as melphalan and cyclophosphamide, aminoglutethimide, asparaginase, busulfan, carboplatin, chlorambucil, cytarabine HCl, dactinomycin, daunorubicin HCl, estramustine phosphate sodium, etoposide (VP16-213), floxuridine, fluorouracil (5-FU), flutamide, hydroxyurea (hydroxycarbamide), ifosfamide, interferon alfa-2a, interferon alfa-2b, leuprolide acetate (LHRH-releasing factor analogue), lomustine (CCNU), mechlorethamine HCl (nitrogen mustard), mercaptopurine, mesna, mitotane (o,p'-DDD), mitoxantrone HCl, octreotide, plicamycin, procarbazine HCl, streptozocin, tamoxifen citrate, thioguanine, thiotepa, vinblastine sulfate, amsacrine (m-AMSA), azacitidine, erythropoietin, hexamethylmelamine (HMM), interleukin 2, mitoguazone (methyl-GAG; methyl glyoxal bis-guanylhydrazone; MGBG), pentostatin (2'deoxycoformycin), semustine (methyl-CCNU), teniposide (VM-26) and vindesine sulfate. Additional exemplary therapeutic compounds for use in pharmaceutical compositions and combinations provided herein can be found elsewhere herein (see e.g., Section E for exemplary cytokines, growth factors, photosensitizing agents, radionuclides, toxins, siRNA molecules, enzyme/pro-drug pairs, anti-metabolites, signaling modulators, anti-cancer antibiotics, anti-cancer antibodies, angiogenesis inhibitors, and chemotherapeutic compounds).

In some examples, the combination can include additional therapeutic compounds such as, for example, compounds that are substrates for enzymes encoded and expressed by the virus, or other therapeutic compounds provided herein or known in the art to act in concert with a virus. For example, the virus can express an enzyme that converts a prodrug into an active chemotherapy drug for killing the cancer cell. Hence, combinations provided herein can contain a therapeutic compound, such as a prodrug. An exemplary virus/therapeutic compound combination can include a virus encoding Herpes simplex virus thymidine kinase with the prodrug ganciclovir. Additional exemplary enzyme/pro-drug pairs, for the use in combinations provided include, but are not limited to, varicella zoster thymidine kinase/ganciclovir, cytosine deaminase/5-fluorouracil, purine nucleoside phosphorylase/6-methylpurine deoxyriboside, beta lactamase/cephalosporin-doxorubicin, carboxypeptidase G2/4-[(2-chloroethyl) (2-mesyloxyethyl)amino]benzoyl-L-glutamic acid, cytochrome P450/acetaminophen, horseradish peroxidase/indole-3-acetic acid, nitroreductase/CB1954, rabbit carboxylesterase/7-ethyl-10-[4-(1-piperidino)-1-piperidino]carbonyloxycamptothecin (CPT-11), mushroom tyrosinase/bis-(2-chloroethyl)amino-4-hydroxyphenylaminomethanone 28, beta galactosidase/1-chloromethyl-5-hydroxy-1,2-dihydro-3H-benz [e]indole, beta glucuronidase/epirubicin-glucuronide, thymidine phosphorylase/5'-deoxy-5-fluorouridine, deoxycytidine kinase/cytosine arabinoside, beta-lactamase and linamerase/linamarin. Additional exemplary prodrugs, for the use in combinations also can be found elsewhere herein (see e.g., Section E). Any of a variety of known combinations provided herein or otherwise known in the art can be included in the combinations provided herein.

In some examples, the combination can include compounds that can kill or inhibit viral growth or toxicity. Such compounds can be used to alleviate one or more adverse side effects that can result from viral infection (see, e.g., U.S. Patent Pub. No. US 2009-016228-A1). Combinations provided herein can contain antibiotic, antifungal, anti-parasitic or antiviral compounds for treatment of infections. In some examples, the antiviral compound is a chemotherapeutic agent that inhibits viral growth or toxicity.

Exemplary antibiotics which can be included in a combination with a carrier cell and virus provided herein include, but are not limited to, ceftazidime, cefepime, imipenem, aminoglycoside, vancomycin and antipseudomonal β-lactam. Exemplary antifungal agents which can be included in a combination with a carrier cell and virus provided herein include, but are not limited to, amphotericin B, dapsone, fluconazole, flucytosine, griseofulvin, itraconazole, ketoconazole, miconazole, clotrimazole, nystatin, and combinations thereof. Exemplary antiviral agents which can be included in a combination with a carrier cell and virus provided herein include, but are not limited to, cidofovir, alkoxyalkyl esters of cidofovir (CDV), cyclic CDV, and(S)-9-(3-hydroxy-2 phosphonylmethoxypropyl) adenine, 5-(dimethoxymethyl)-2'-deoxyuridine, isatin-beta-thiosemicarbazone, N-methanocarbathymidine, brivudine, 7-deazaneplanocin A, ST-246, Gleevec, 2'-beta-fluoro-2',3'-dideoxyadenosine, indinavir, nelfinavir, ritonavir, nevirapine, AZT, ddI, ddC, and combinations thereof. Typically, combinations with an antiviral agent contain an antiviral agent known to be effective against the virus of the combination. For example, combinations can contain a vaccinia virus with an antiviral compound, such as cidofovir, alkoxyalkyl esters of cidofovir, ganciclovir, acyclovir, ST-246, Gleevec, and derivatives thereof.

In some examples, the combination can include a detectable compound. A detectable compound can include, for example, a ligand, substrate or other compound that can interact with and/or bind specifically to a protein or RNA encoded and expressed by the virus or carrier cell, and can provide a detectable signal, such as a signal detectable by tomographic, spectroscopic, magnetic resonance, or other known techniques. In some examples, the protein or RNA is an exogenous protein or RNA. In some examples, the protein or RNA expressed by the virus or carrier cell modifies the detectable compound where the modified compound emits a detectable signal. Exemplary detectable compounds can be, or can contain, an imaging agent such as a magnetic resonance, ultrasound or tomographic imaging agent, including a radionuclide. The detectable compound can include any of a variety of compounds as provided elsewhere herein or are otherwise known in the art. Exemplary proteins that can be expressed by the virus or carrier cell and a detectable compound combinations employed for detection include, but are not limited to luciferase and luciferin, β-galactosidase and (4,7,10-tri (acetic acid)-1-(2-β-galactopyranosylethoxy)-1,4,7,10-tetraazacyclododecane) gadolinium (Egad), and other combinations known in the art.

In some examples, the combination can include a gene expression-modulating compound that regulates expression of one or more genes encoded by the virus or carrier cell. Compounds that modulate gene expression are known in the art, and include, but are not limited to, transcriptional activators, inducers, transcriptional suppressors, RNA polymerase inhibitors and RNA binding compounds such as siRNA or ribozymes. Any of a variety of gene expression modulating compounds known in the art can be included in the combinations provided herein. Typically, the gene expression-modulating compound included with a virus in the combinations provided herein will be a compound that can bind, inhibit or react with one or more compounds, active in gene expression such as a transcription factor or RNA of the virus or carrier cell of the combination. An exemplary virus or carrier cell/expression modulator combination can be a virus or carrier cell encoding a chimeric transcription factor complex having a mutant human progesterone receptor fused to a yeast GAL4 DNA-binding domain an activation domain of the herpes simplex virus protein VP16 and also containing a synthetic promoter containing a series of GAL4 recognition sequences upstream of the adenovirus major late E1B TATA box, where the compound can be RU486 (see, e.g., Yu et al. (2002) *Mol Genet Genomics* 268:169-178). A variety of other virus or carrier cell/expression modulator combinations known in the art also can be included in the combinations provided herein.

In some examples, the combination can contain nanoparticles. Nanoparticles can be designed such that they carry one or more therapeutic agents provided herein. Additionally, nanoparticles can be designed to carry a molecule that targets the nanoparticle to the tumor cells. In one non-limiting example, nanoparticles can be coated with a radionuclide and, optionally, an antibody immunoreactive with a tumor-associated antigen.

In some examples, the combination can contain one or more additional therapeutic and/or diagnostic viruses or other therapeutic and/or diagnostic microorganism (e.g., therapeutic and/or diagnostic bacteria) for diagnosis or treatment. Exemplary therapeutic and/or diagnostic viruses are known in the art and include, but are not limited to, therapeutic and/or diagnostic poxviruses, herpesviruses, adenoviruses, adeno-associated viruses, and reoviruses. Exemplary oncolytic viruses are described herein above.

3. Kits

The CAVES, pharmaceutical compositions or combinations provided herein can be packaged as kits. Kits can optionally include one or more components such as instructions for use, devices and additional reagents, and components, such as tubes, containers and syringes for practice of the methods. Exemplary kits can include a CAVES system provided herein and, optionally, include instructions for use, a device for detecting a carrier cell and/or virus in a subject, a device for administering the CAVES to a subject, or a device for administering an additional agent or compound to a subject.

In one example, a kit can contain instructions. Instructions typically include a tangible expression describing the CAVES system and, optionally, other components included in the kit, and methods for administration, including methods for determining the proper state of the subject, the proper dosage amount, and the proper administration method, for administering the carrier cell and virus. Instructions also can include guidance for monitoring the subject over the duration of the treatment time.

In another example, a kit can contain a device for detecting a carrier cell and/or virus in a subject. Devices for detecting a carrier cell and/or virus in a subject can include a low light imaging device for detecting light, for example, emitted from luciferase, or fluoresced from a fluorescent protein, such as a green or red fluorescent protein, a magnetic resonance measuring device such as an MRI or NMR device, a tomographic scanner, such as a PET, CT, CAT, SPECT or other related scanner, an ultrasound device, or other device that can be used to detect a protein expressed by the carrier cell and/or virus within the subject. Typically, the device of the kit will be able to detect one or more proteins expressed by the carrier cell and/or virus of the kit. Any of a variety of kits containing carrier cells, viruses and detection devices can be included in the kits provided herein, for example, a carrier cell or virus expressing luciferase and a low light imager or a carrier cell or virus expressing a fluorescent protein, such as a green or red fluorescent protein, and a low light imager.

Kits provided herein also can include a device for administering a CAVES system to a subject. Any of a variety of devices known in the art for administering medications, pharmaceutical compositions and vaccines can be included in the kits provided herein. Exemplary devices include, but are not limited to, a hypodermic needle, an intravenous needle, a catheter, a needle-less injection device, an inhaler and a liquid dispenser, such as an eyedropper. For example, a CAVES system to be delivered systemically, for example, by intravenous injection, can be included in a kit with a hypodermic needle and syringe. Typically, the device for administering a CAVES of the kit will be compatible with the carrier cell and virus of the kit; for example, a needle-less injection device such as a high pressure injection device can be included in kits with CAVES not damaged by high pressure injection, but is typically not included in kits with CAVES damaged by high pressure injection.

Kits provided herein also can include a device for administering an additional agent or compound to a subject. Any of a variety of devices known in the art for administering medications to a subject can be included in the kits provided herein. Exemplary devices include, but are not limited to, a hypodermic needle, an intravenous needle, a catheter, a needle-less injection device, an inhaler and a liquid dispenser, such as an eyedropper. Typically the device for administering the compound of the kit will be compatible with the desired method of administration of the compound. For example, a compound to be delivered systemically or subcutaneously can be included in a kit with a hypodermic needle and syringe.

The kits provided herein also can include any device for applying energy to a subject, such as electromagnetic energy. Such devices include, but are not limited to, a laser, light-emitting diodes, fluorescent lamps, dichroic lamps, and a light box. Kits also can include devices to effect internal exposure of energy to a subject, such as an endoscope or fiber optic catheter.

E. Combination (Additional) Therapies Administered with CAVES

Virotherapy using the combinations, compositions or kits provided herein containing a CAVES as provided herein for delivery of an oncolytic virus expression/replication system to a subject in need of virotherapy, can be used alone or in further combination with other therapies or treatments. Any of the therapeutic proteins described in Section B for modifying oncolytic viruses, e.g., therapeutic antibodies and immune checkpoint inhibitors, also can be administered in addition to or instead as a separate treatment. The combinations or compositions provided herein can further be co-formulated or co-administered together with, prior to, intermittently with, or subsequent to, other therapeutic or pharmacologic agents or treatments, such as procedures. For example, such agents include, but are not limited to, other biologics, anti-cancer agents, small molecule compounds, dispersing agents, anesthetics, checkpoint inhibitors, vasoconstrictors, surgery, radiation, a chemotherapeutic agent, a biological agent, a polypeptide, an antibody, a peptide, a small molecule, a gene therapy vector, a virus and DNA and combinations thereof. Such agents also can include one or more agents to ameliorate, reduce or prevent side effects. In some cases, the combination therapy can be used in combination with one or more cancer treatments that remove the primary tumor or that immunosuppress the subject prior to treatment. For example, additional chemotherapy or radiation therapy can be used in addition to the combination therapy provided herein. Such additional therapy can have the effect of weakening a subject's immune system. In other examples, surgical removal and/or immune-system weakening therapy may not be necessary. Exemplary other methods that can be combined therein include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimens for second agents/treatments herein are known to one of skill in the art.

For example, the combination therapy provided herein can be used in further combination with one or more of the following including, but not limited to, immune co-stimulation agonists (e.g., B7 Family (CD28, ICOS); TNFR family (4-1BB, OX40, GITR, CD40, CD30, CD27); LIGHT, LTa); BiTEs; CAR-T cells, adaptive T-cell therapy, e.g., NK-92 cell line, and TCR transgenic T cell targeting tumor-specific antigens; co-stimulatory molecules, therapeutic antibodies including single chain antibodies, Avastin, aflibercept, Vanucizumab, bi-antibodies, antibody-drug conjugates, Checkpoint Inhibitors (Targets include PD-1, PD-2, PD-L1, PD-L2, CTLA-4, IDO 1 and 2, CTNNB1 (B-catenin), SIRPa, VISTA, LIGHT, HVEM, LAG3, TIM3, TIGIT, Galectin-9, KIR, GITR, TIM1, TIM4, CEACAMI, CD27, CD40/CD40L, CD48, CD70, CD80, CD86, CD112, CD137 (4-1BB), CD155, CD160, CD200, CD226, CD244 (2B4), CD272 (BTLA), B7-H2, B7-H3, B7-H4, B7-H6, ICOS, A2aR, A2bR, HHLA2, ILT-2, ILT-4, gp49B, PIR-B, HLA-G, ILT-2/4 and OX40/OX-40L, MDR1, Arginasel, iNOs, IL-10, TGF-β, pGE2, STAT3, VEGF, KSP, HER2, Ras, EZH2, NIPP1, PP1, TAK1 and PLKla); and chemotherapeutic compounds and antibodies.

Exemplary chemotherapeutic compounds and antibodies for administering in addition to the virotherapy provided herein can include Cytokines, Chemokines, Growth Factors, Photosensitizing Agents, Toxins, Anti-Cancer Antibiotics, Chemotherapeutic Compounds, Radionuclides, Angiogenesis Inhibitors, Signaling Modulators, Antimetabolites, Anti-cancer Vaccines, Anti-cancer Oligopeptides, Mitosis Inhibitor Proteins, Antimitotic Oligopeptides, Anti-cancer Antibodies, Anti-cancer Antibiotics and Immunotherapeutic Agents.

Exemplary anti-cancer agents and agents for treating cancer patients that can be administered after, coincident with or before administration of the combination therepy herein, include, but are not limited to Acivicins; Avicin; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes;

Exisulinds; Fadrozoles; Fazarabines; Fenretinides; Filgrastims; Floxuridines; Fludarabines; Fluorouracils; 5-fluorouracils; Fluoxymesterones; Flurocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g. PROLEUKIN®); Alemtuzumabs (e.g. CAMPATH®); Alitretinoins (e.g. PANRETIN®); Allopurinols (e.g. ZYLOPRIM®); Altretamines (e.g. HEXALEN®); Amifostines (e.g. ETHYOL®); Anastrozoles (e.g. ARIMIDEX®); Arsenic Trioxides (e.g. TRISENOX®); Asparaginases (e.g. ELSPAR®); BCG Live (e.g. TICE® BCG); Bexarotenes (e.g. TARGRETIN®); Bevacizumab (AVASTIN®); Bleomycins (e.g. BLENOXANE®); Busulfan intravenous (e.g. BUSULFEX®); Busulfan orals (e.g. MYLERAN®); Calusterones (e.g. METHOSARBR); Capecitabines (e.g. XELODA®); Carboplatins (e.g. PARAPLATIN®); Carmustines (e.g. BCNUR, BiCNU®); Carmustines with Polifeprosans (e.g. GLIADEL® Wafer); Celecoxibs (e.g. CELEBREX®); Chlorambucils (e.g. LEUKERAN®); Cisplatins (e.g. PLATINOL®); Cladribines (e.g. LEUSTATIN®, 2-CdA®); Cyclophosphamides (e.g. CYTOXAN®, NEOSAR®); Cytarabines (e.g. CYTOSAR-U®); Cytarabine liposomals (e.g. DepoCyt®); Dacarbazines (e.g. DTIC-Dome): Dactinomycins (e.g. COSMEGEN®); Darbepoetin Alfas (e.g. ARANESP®); Daunorubicin liposomals (e. g. DANUOXOME®); Daunorubicins/Daunomycins (e.g. CERUBIDINE®); Denileukin Diftitoxes (e.g. ONTAK®); Dexrazoxanes (e.g. ZINECARD®); Docetaxels (e.g. TAXOTERE®); Doxorubicins (e.g. ADRIAMYCIN®, RUBEX®); Doxorubicin liposomals, including Doxorubicin HCL liposome injections (e.g. DOXIL®); Dromostanolone propionates (e.g. DROMOSTANOLONE® and MASTERONE® Injection); Elliott's B Solutions (e.g. Elliott's B Solution®); Epirubicins (e.g. ELLENCE®); Epoetin alfas (e.g. EPOGEN®); Estramustines (e.g. EMCYT®); Etoposide phosphates (e.g. ETOPOPHOS®); Etoposide VP-16s (e.g. VEPESID®); Exemestanes (e.g. AROMASIN®); Filgrastims (e.g. NEUPOGEN®); Floxuridines (e.g. FUDR®); Fludarabines (e.g. FLUDARA®); Fluorouracils incl. 5-FUs (e.g. ADRUCIL®); Fulvestrants (e.g. FASLODEX®); Gemcitabines (e.g. GEMZAR®); Gemtuzumabs/Ozogamicins (e.g. MYLOTARG®); Goserelin acetates (e.g. ZOLADEX®); Hydroxyureas (e.g. HYDREA®); Ibritumomabs/Tiuxetans (e.g. ZEVALIN®); Idarubicins (e.g. IDAMYCIN®); Ifosfamides (e.g. IFEX®); Imatinib mesylates (e.g. GLEEVEC®); Interferon alfa-2as (e.g. ROFERON-A®); Interferon alfa-2bs (e.g. INTRON A®); Irinotecans (e.g. CAMPTOSAR®); Letrozoles (e.g. FEMARA®); Leucovorins (e.g. WELLCOVORIN®, LEUCOVORIN®); Levamisoles (e.g. ERGAMISOL®); Lomustines/CCNUs (e.g. CeeBUR); Mechlorethamines/Nitrogen mustards (e.g. MUSTARGEN®); Megestrol acetates (e.g. MEGACE®); Melphalans/L-PAMs (e.g. ALKERAN®); Mercaptopurine, including 6-mercaptopurines (6-MPs; e.g. PURINETHOL®); Mesnas (e.g. MESNEX®); Methotrexates; Methoxsalens (e.g. UVADEX®); Mitomycin Cs (e.g. MUTAMYCIN®, MITOZYTREX®); Mitotanes (e.g. LYSODREN®); Mitoxantrones (e.g. NOVANTRONE®); Nandrolone Phenpropionates (e.g. DURABOLIN-50®); Nofetumomabs (e.g. VERLUMA®); Oprelvekins (e.g. NEUMEGA®); Oxaliplatins (e.g. ELOXATIN®); Paclitaxels (e.g. PAXENE®, TAXOL®); Pamidronates (e.g. AREDIA®); Pegademases (e.g. ADAGEN®); Pegaspargases (e.g. ONCASPAR®); Pegfilgrastims (e.g. NEULASTA®); Pentostatins (e.g. NIPENT®); Pipobromans (e.g. VERCYTE®); Plicamycin/Mithramycins (e.g.

MITHRACIN®); Porfimer sodiums (e.g. PHOTOFRIN®); Procarbazines (e.g. MATULANE®); Quinacrines (e.g. ATABRINE®); Rasburicases (e.g. ELITEK®); Rituximabs (e.g. RITUXAN®); Sargramostims (e.g. PROKINE®); Streptozocins (e.g. ZANOSAR®); Sunitinib Malates (e.g. SUTENT®); Talcs (e.g. SCLEROSOL®); Tamoxifens (e.g. NOLVADEX®); Temozolomides (e.g. TEMODAR®); Teniposides/VM-26s (e.g. VUMON®); Testolactones (e.g. TESLAC®); Thioguanines including, 6-thioguanine (6-TG); Thiotepas (e.g. THIOPLEX®); Topotecans (e.g. HYCAMTIN®); Toremifenes (e.g. FARESTON®); Tositumomabs (e.g. BEXXAR®); Trastuzumabs (e.g. HERCEPTIN®); Tretinoins/ATRA (e.g. VESANOID®); Uracil Mustards; Valrubicins (e.g. VALSTAR®); Vinblastines (e.g. VELBAN®); Vincristines (e.g. ONCOVIN®); Vinorelbines (e.g. NAVELBINE®); and Zoledronates (e.g. ZOMETA®).

Exemplary checkpoint inhibitors that can be administered after, coincident with or before administration of a therapy herein, include, but are not limited to, anti-CTLA4 agents, anti-PF-1 agents and others, exemplary of which are the following:

Exemplary inhibitory immune checkpoint target proteins and inhibitors

| Target | Target Function | Antibody/fusion protein | Synonyms and Code Names |
|---|---|---|---|
| CTLA4 | Inhibitory receptor | Ipilimumab<br>Tremelimumab | (MDX-CTLA-4; BMS-734016; MDX-010) (ticilimumab; CP-675,206) |
| PD-1 | Inhibitory receptor | MK-3475<br>AMP-224<br>Nivolumab<br>Pidilizumab | (Pembrolizumab; Lambrolizumab; SCH 900475) (anti-PD-1 fusion protein AMP-224) (BMS-936558; MDX-1106; ONO-4538) (CT-011) |
| PD-L1 | Ligand for PD-1 | MDX-1105<br>BMS-936559<br>MED 14736<br>MPDL33280A | (RG7446) |
| LAG3 | Inhibitory receptor | IMP321 | ImmuFact |
| B7-H3 | Inhibitory ligand | MGA271 | |
| B7-H4 | Inhibitory ligand | | |
| TIM3 | Inhibitory receptor | | |
| CD25 | inhibitory receptor subunit | | |
| CD137 | stimulatory receptor | | |
| OX40 | stimulatory receptor | | |
| 4-1BB | co-stimulatory receptor | Aptamer ligand | |
| IDO | immunosuppressive enzyme | | |

The additional treatments administered with the combinations for virotherapy provided herein can include one or more immunosuppressive drugs, for example, Glucocorticoids (e.g., prednisone, dexamethasone, hydrocortisone); Calcineurin Inhibitors (e.g., cyclosporin, tacrolimus); mTOR Inhibitors (e.g., sirolimus, everolimus); Methotrexate; Lenalidomide; Azathioprine; Mercaptopurine; Fluorouracil; Cyclophosphamide; TNFα blocking antibodies (e.g., infliximab/Remicade, etanercept/Enbrel, adalimumab/Humira) and Fludarabine.

F. Modes of Administration of CAVES for Therapy

The cell-assisted viral expression system(s) (CAVES) provided herein can be administered to a subject, including a subject having a tumor or having neoplastic cells, for therapy. An administered CAVES can be a CAVES provided herein or any other CAVES generated using the methods provided herein. In some examples, the carrier cells/cell vehicles used in the CAVES are autologous cells (i.e., derived from the patient) or allogeneic cells (i.e., not derived from the patient) that are stem cells, immune cells, or cancer cells. The carrier cells can be sensitized, for example, to enhance virus amplification ability, to block induction of the anti-viral state, to protect against allogeneic inactivation/rejection determinants, and to protect against complement, or the carrier cells can be engineered, for example, to be unresponsive to an interferon-induced antiviral state, to evade allogeneic recognition by T cells, NK cells and NKT cells, to express immunosuppressive factors of human or viral origin, to express cancer- or stem cell-derived factors sensitizing poorly permissive tumor cells to oncolytic virus infection, and to express factors interfering with the function of complement and neutralizing antibodies. In some examples, the virus administered is a virus containing a characteristic such as attenuated pathogenicity, low toxicity, preferential accumulation in tumor, ability to activate an immune response against tumor cells, high immunogenicity, replication competence and ability to express exogenous proteins, including immunomodulatory proteins and immunotherapeutic proteins, such as antibodies against checkpoint inhibitors, and agonists of costimulatory molecules, and combinations thereof.

a. Administration of Irradiated or Non-irradiated CAVES

The carrier cells used in the CAVES can be irradiated prior to, or following, infection with oncolytic virus. In order to use transformed cells as cell carriers for oncolytic virotherapy, uninfected cells must be prevented from establishing new metastatic growth following administration. This can be accomplished by y-irradiation of carrier cells before or after viral infection, prior to administration, which ablates tumorigenicity, but preserves metabolic activity and does not affect viral production/amplification and release. For example, carrier cells can be irradiated up to 24 hours before viral infection, or up to 24 hours after viral infection.

The amount of radiation can be selected by one skilled in the art according to any of a variety of factors, including the nature of the carrier cell and virus in the CAVES. The radiation amount can be sufficient to inactivate the carrier cells and prevent tumorigenesis without affecting viral infection, amplification and release. For example, the amount of radiation can be about 5 Gy, 10 Gy, 15 Gy, 20 Gy, 25 Gy, 30 Gy, 35 Gy, 40 Gy, 45 Gy 50 Gy, 100 Gy, 120 Gy, 150 Gy, 200 Gy, 250 Gy, 500 Gy or more.

b. Routes of Administration

The CAVES can be delivered or administered to a subject locally or systemically. For example, modes of administration include, but are not limited to, systemic, parenteral, intravenous, intraperitoneal, subcutaneous, intramuscular, transdermal, intradermal, intra-arterial (e.g., hepatic artery infusion), intravesicular perfusion, intrapleural, intraarticular, topical, intratumoral, intralesional, endoscopic, multipuncture (e.g., as used with smallpox vaccines), by inhalation, percutaneous, subcutaneous, intranasal, intratracheal, oral, intracavity (e.g., administering to the bladder via a catheter, administering to the gut by suppository or enema), vaginal, rectal, intracranial, intraprostatic, intravitreal, aural, ocular or topical administration.

One skilled in the art can select any mode of administration compatible with the subject and the CAVES, and that also is likely to result in the CAVES reaching and entering the target cell-type or tissue, e.g., tumors and/or metastases. The route of administration can be selected by one skilled in the art according to any of a variety of factors, including the nature of the disease, the properties of the target cell or tissue (e.g., the kind of tumor), and the particular CAVES to be administered. Administration to the target site can be performed, for example, by ballistic delivery, as a colloidal dispersion system, or systemic administration can be performed by injection into an artery.

c. Devices

Any of a variety of devices known in the art for administering medications, pharmaceutical compositions and vaccines can be used for administering the CAVES.

Exemplary devices include, but are not limited to, a hypodermic needle, an intravenous needle, a catheter, a needle-less injection device, an inhaler and a liquid dispenser, such as an eyedropper. For example, the Qaudra-Fuse™ multi-pronged injection needle (Rex Medical, Conshohocken, PA) can be used.

Typically, the device for administering a CAVES will be compatible with the CAVES; for example, a needle-less injection device such as a high-pressure injection device can be used with CAVES that are not damaged by high-pressure injection, but is typically not used with CAVES that are damaged by high-pressure injection. Also provided herein are devices for administering an additional agent or compound to a subject. Any of a variety of devices known in the art for administering medications to a subject can be used. Exemplary devices include, but are not limited to, a hypodermic needle, an intravenous needle, a catheter, a needle-less injection device, an inhaler and a liquid dispenser, such as an eyedropper. Typically the device for administering the compound will be compatible with the desired method of administration of the compound. For example, a compound to be delivered systemically or subcutaneously can be administered with a hypodermic needle and syringe.

d. Dosages of Administration

The dosage regimen can be any of a variety of methods and amounts, and can be determined by one skilled in the art according to known clinical factors. As is known in the medical arts, dosages for any one patient can depend on many factors, including the subject's species, size, body surface area, age, sex, immunocompetence, and general health, the particular CAVES to be administered, duration and route of administration, the kind and stage of the disease, for example, tumor size, and other treatments or compounds, such as chemotherapeutic drugs, being administered concurrently. In addition to the above factors, such levels can be affected by the infectivity and amplification potential of the virus, and the nature of the CAVES, as can be determined by one skilled in the art.

In the present methods, appropriate minimum dosage levels and dosage regimens of CAVES can be levels sufficient for the CAVES to deliver virus to the target site and for the virus to survive, grow and replicate in a tumor or metastasis. Generally, 100,000 to 1 billion unmodified, sensitized, protected or genetically engineered allogeneic or autologous carrier cells are infected ex vivo with any suitable oncolytic virus, including an oncolytic virus chosen based on the co-culture screen and analysis methods provided herein, at a multiplicity of infection (MOI) of 0.01 and higher, to generate the CAVES. For example, the carrier cells are infected at an MOI of between at least or about 0.01 to at least or about 10.0, or at an MOI between at least or about 0.01, 0.02, 0.03, 0.04 or 0.05 to at least or about 0.1, 0.2, 0.3, 0.4, 0.5, 0.6, 0.7, 0.8, 0.9, 1.0, 2.0, 3.0, 4.0 or 5.0, for example an MOI of at least about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0 or more. The infected carrier cells are then incubated for a time of between at least or about 6 hours to at least or about 72 hours or more, to generate the CAVES. For example, the incubation time to generate the CAVES can be between at least or about 6, 7, 8, 9, 10, 11, 12, 13, 14, 15, 16, 17 or 18 hours to at least or about 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 or more hours. In some embodiments, the MOI is 0.1 and the incubation time to generate the CAVES is at least or about 24, 25, 26, 27, 28, 29, 30, 31, 32, 33, 34, 35, 36, 37, 38, 39, 40, 41, 42, 43, 44, 45, 46, 47 or 48 or more hours. For example, the MOI is 0.1 and the incubation time to generate the CAVES is between about 38 to about 42 hours, for example about 38, 39, 40, 41 or 42 hours. In exemplary embodiments, the MOI is 0.1 and the incubation time to generate the CAVES is about 28 hours and in some embodiments, the MOI is 0.5 and the incubation time to generate the CAVES is between about 18 to about 24 hours, for example about 18, 19, 20, 21, 22, 23 or 24 hours. In any of the aforementioned embodiments, the cell carrier can be a stem cell, for example, MSC cells or cultured AD-MSC (derived from CD34+SA-ASC), or SVF cells or subpopulations thereof, such as supra adventitial-adipose stromal cells (SA-ASC; CD235a−/CD45−/CD 34+/CD146−/CD31−) or pericytes (CD235a−/CD45−/CD34−/CD146+/CD31−). In further embodiments, the virus is Vaccinia virus (VACV), for example ACAM1000 or ACAM2000; in embodiments, the VACV is ACAM2000 having the sequence set forth in SEQ ID NO:70, or is a CAL1 virus having the sequence set forth in SEQ ID NO: 71. For the compositions and methods provided herein, cell carriers/CAVES that produce a pfu/cell of at least at or about 2, 3, 4, 5, 6, 7, 8, 9, 10 or more are selected. For example, cell carriers/CAVES that produce a pfu/cell of at least or at least about 10, at least or at least about 100, at least or at least about 1,000 or higher are selected. Generally, the virus is administered in an amount that is at least or about or $1\times10^5$ pfu at least one time over a cycle of administration. Exemplary minimum levels for administering a virus to a 65 kg human can include at least about $1\times10^5$ plaque forming units (pfu), at least about $5\times10^5$ pfu, at least about $1\times10^6$ pfu, at least about $5\times10^6$ pfu, at least about $1\times10^7$ pfu, at least about $1\times10^8$ pfu, at least about $1\times10^9$ pfu, or at least about $1\times10^{10}$ pfu. For example, the virus is administered in an amount that is at least or about or is $1\times10^5$ pfu, $1\times10^6$ pfu, $1\times10^7$ pfu, $1\times10^8$ pfu, $1\times10^9$ pfu, $1\times10^{10}$ pfu, $1\times10^{11}$ pfu, $1\times10^{12}$ pfu, $1\times10^{13}$ pfu, or $1\times10^{14}$ pfu at least one time over a cycle of administration.

e. Regimens

In the dosage regimen, the amount of CAVES can be administered as a single administration or multiple times over the cycle of administration. Hence, the methods provided herein can include a single administration of CAVES to a subject or multiple administrations of CAVES to a subject. In some examples, a single administration is sufficient to deliver and establish a virus in a tumor, where the virus can proliferate and can cause or enhance an anti-tumor response in the subject; such methods do not require additional administrations of CAVES in order to cause or enhance an anti-tumor response in a subject, which can result, for example in inhibition of tumor growth, inhibition of metastasis growth or formation, reduction in tumor size, elimination of a tumor or metastasis, inhibition or prevention of recurrence of a neoplastic disease or new tumor formation, or other cancer therapeutic effects.

In other examples, the CAVES can be administered on different occasions, separated in time typically by at least one day. For example, the CAVES can be administered two times, three time, four times, five times, or six times or more, with one day or more, two days or more, one week or more, or one month or more time between administrations. Separate administrations can increase the likelihood of delivering a virus to a tumor or metastasis, where a previous administration has been ineffective in delivering a virus to a tumor or metastasis. Separate administrations can increase the locations on a tumor or metastasis where virus proliferation can occur or can otherwise increase the titer of virus accumulated in the tumor, which can increase the scale of release of antigens or other compounds from the tumor in eliciting or enhancing a host's anti-tumor immune response, and also can, optionally, increase the level of virus-based tumor lysis or tumor cell death. Separate administrations of the CAVES can further extend a subject's immune response against viral antigens, which can extend the host's immune response to tumors or metastases in which viruses have accumulated, and can increase the likelihood of a host mounting an anti-tumor immune response.

When separate administrations are performed, each administration can be a dosage amount that is the same or different relative to other administration dosage amounts. In one example, all administration dosage amounts are the same. In other examples, a first dosage amount can be a larger dosage amount than one or more subsequent dosage amounts, for example, at least 10× larger, at least 100× larger, or at least 1000× larger than subsequent dosage amounts. In one example of a method of separate administrations in which the first dosage amount is greater than one or more subsequent dosage amounts, all subsequent dosage amounts can be the same, or a smaller amount relative to the first administration. Separate administrations can include any number of two or more administrations, including two, three, four, five or six administrations. One skilled in the art readily can determine the number of administrations to perform or the desirability of performing one or more additional administrations according to methods known in the art for monitoring therapeutic methods and other monitoring methods provided herein. Accordingly, the methods provided herein include methods of providing to the subject one or more administrations of CAVES, where the number of administrations can be determined by monitoring the subject, and, based on the results of the monitoring, determining whether or not to provide one or more additional administrations. Deciding on whether or not to provide one or more additional administrations can be based on a variety of monitoring results, including, but not limited to, indication of tumor growth or inhibition of tumor growth, appearance of new metastases or inhibition of metastasis, the subject's anti-virus antibody titer, the subject's anti-tumor antibody titer, the overall health of the subject, the weight of the subject, the presence of virus solely in tumor and/or metastases, and the presence of virus in normal tissues or organs.

The time period between administrations can be any of a variety of time periods. The time period between administrations can be a function of any of a variety of factors, including monitoring steps, as described in relation to the number of administrations, the time period for a subject to mount an immune response, the time period for a subject to clear the virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

For example, an amount of CAVES is administered two times, three times, four times, five times, six times or seven times over a cycle of administration. The amount of CAVES can be administered on the first day of the cycle, the first and second day of the cycle, each of the first three consecutive days of the cycle, each of the first four consecutive days of the cycle, each of the first five consecutive days of the cycle, each of the first six consecutive days of the cycle, or each of the first seven consecutive days of the cycle. Generally, the cycle of administration is 7 days, 14 days, 21 days or 28 days. Depending on the responsiveness or prognosis of the patient, the cycle of administration is repeated over the course of several months or years.

Generally, appropriate maximum dosage levels or dosage regimens of CAVES are levels that are not toxic to the host, levels that do not cause splenomegaly of 3 times or more, levels that do not result in viral colonies or plaques in normal tissues or organs after about 1 day or after about 3 days or after about 7 days.

G. Treatment Methods and Monitoring Coordinated with Treatment

Provided herein are methods of treatment by administering a cell-assisted viral expression system, or CAVES, as provided herein to facilitate delivery of the virus, to treat a subject having a proliferative or inflammatory disease or condition. In particular, the condition is associated with immunoprivileged cells or tissues. A disease or condition associated with immunoprivileged cells or tissues includes, for example, proliferative disorders or conditions, including the treatment (such as inhibition) of cancerous cells, neoplasms, tumors, metastases, cancer stem cells, and other immunoprivileged cells or tissues, such as wounds and wounded or inflamed tissues. In particular examples of such methods, the CAVES provided herein are administered by intravenous administration for systemic delivery. In other examples, the CAVES provided herein are administered by intratumoral injection. In embodiments, the subject has cancer. Any of the CAVES provided herein can be used to provide virotherapy to subjects in need thereof, including CAVES comprising sensitized cell vehicles, protected cell vehicles, engineered cell vehicles and matched cell vehicles, which can include sensitized/engineered cell vehicles that additionally are screened by the matching assays described in U.S. Provisional Patent Application No. 62/680,570, and U.S. application Ser. No. 16/536,073.

The CAVES provided herein can be administered by a single injection, by multiple injections, or continuously. For example, the CAVES can be administered by slow infusion including using an intravenous pump, syringe pump, intravenous drip or slow injection. For example, continuous administration of the CAVES can occur over the course of minutes to hours, such as between or about between 1 minute to 1 hour, such as between 20 and 60 minutes.

Cancers amenable to the treatment and detection methods described herein also include cancers that metastasize. It is understood by those in the art that metastasis is the spread of cells from a primary tumor to a noncontiguous site, usually via the bloodstream or lymphatics, which results in the establishment of a secondary tumor growth. Examples of cancers contemplated for treatment include, but are not limited, to solid tumors and hematologic malignancies, such as, for example, melanoma, including choroidal and cutaneous melanoma, bladder cancer, non-small cell lung cancer, small cell lung cancer, lung cancer, head and neck cancer, breast cancer, pancreatic cancer, gum cancer, tongue cancer, prostate cancer, renal cancer, bone cancer, testicular cancer, ovarian cancer, cervical cancer, gastrointestinal cancer, lymphoma, brain cancer, colon cancer, rectal cancer, choriocarcinoma, gliomas, carcinomas, basal cell carcinoma, biliary tract cancer, central nervous system (CNS) cancer, connective tissue cancer, cancer of the digestive system, endometrial cancer, esophageal cancer, eye cancer, gastric cancer, intra-epithelial neoplasm, kidney cancer, larynx cancer, leukemia, liver cancer, Hodgkin's lymphoma, Non-Hodgkin's lymphoma, myeloma, neuroblastoma, oral cavity cancer, retinoblastoma, rhabdomyosarcoma, cancer of the respiratory system, sarcoma, skin cancer, stomach cancer, testicular cancer, thyroid cancer, uterine cancer, cancer of the urinary system, lymphosarcoma, osteosarcoma, mammary tumors, mastocytoma, adenosquamous carcinoma, carcinoid lung tumor, bronchial gland tumor, bronchiolar adenocarcinoma, fibroma, myxochondroma, pulmonary sarcoma, neurosarcoma, osteoma, papilloma, hepatocarcinoma, mesothelioma, astrocytoma, glioblastoma, Ewing's sarcoma, Wilm's tumor, Burkitt's lymphoma, microglioma, osteoclastoma, oral neoplasia, fibrosarcoma, genital squamous cell carcinoma, transmissible venereal tumor, testicular tumor, seminoma, Sertoli cell tumor, hemangiopericytoma, histiocytoma, chloroma, granulocytic sarcoma, corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma, cystadenoma, follicular lymphoma, intestinal lymphosarcoma, hepatocellular carcinoma, pulmonary adenomatosis, pulmonary sarcoma, Rous sarcoma, reticulo-endotheliosis, nephroblastoma, B-cell lymphoma, lymphoid leukosis, retinoblastoma, hepatic neoplasia, lymphosarcoma, plasmacytoid leukemia, swimbladder sarcoma (in fish), caseous lymphadenitis, lung carcinoma, insulinoma, sarcoma, neuroma, pancreatic islet cell tumor, gastric MALT lymphoma, gastric adenocarcinoma, pulmonary squamous cell carcinoma, leukemia, hemangiopericytoma, ocular neoplasia, preputial fibrosarcoma, ulcerative squamous cell carcinoma, preputial carcinoma, connective tissue neoplasia, and any other tumors or neoplasms that are metastasized or at risk of metastasis.

The subject of the methods provided herein can be any subject, such as an animal or plant subject, including mammal or avian species. For example, the animal subject can be a human or non-human animal including, but not limited to, domesticated and farm animals, such as a pig, cow, a goat, sheep, horse, cat, or dog. In particular examples, the animal subject is a human subject. In particular examples, the human subject is a pediatric patient.

The methods provided herein can further include one or more steps of monitoring the subject, monitoring the tumor, and/or monitoring the CAVES/virus administered to the subject. Any of a variety of monitoring steps can be included in the methods provided herein, including, but not limited to, monitoring tumor size, monitoring anti-(tumor antigen) antibody titer, monitoring the presence and/or size of metastases, monitoring the subject's lymph nodes, monitoring the subject's weight or other health indicators including blood or urine markers, monitoring anti-(viral antigen) antibody titer, monitoring viral expression of a detectable gene product, and directly monitoring viral titer in a tumor, tissue or organ of a subject.

The purpose of the monitoring can be for assessing the health state of the subject or the progress of therapeutic treatment of the subject, or can be for determining whether or not further administration of the same or a different CAVES/virus is warranted, or for determining when or whether or not to administer a compound to the subject where the compound can act to increase the efficacy of the therapeutic method, or the compound can act to decrease the pathogenicity of the virus administered to the subject.

Tumor and/or metastasis size can be monitored by any of a variety of methods known in the art, including external assessment methods or tomographic or magnetic imaging methods, such as the detection methods described herein. In addition, methods provided herein, for example, monitoring gene expression (e.g., viral gene expression), can be used for monitoring tumor and/or metastasis size.

Monitoring tumor size over several time points can provide information regarding the efficacy of the therapeutic methods provided herein. In addition, monitoring the increase or decrease in size of a tumor or metastasis, also can provide information regarding the presence (i.e., detection and/or diagnosis) of additional tumors and/or metastases in the subject. Monitoring tumor size over several time points can provide information regarding the development of a neoplastic disease in a subject, including the efficacy of treatments of a neoplastic disease in a subject, such as the treatments provided herein.

The methods provided herein also can include monitoring the antibody titer in a subject, including antibodies produced in response to the administration of CAVES. For example, the CAVES/viruses administered in the methods provided herein can elicit an immune response to endogenous viral antigens. The CAVES/viruses administered in the methods provided herein also can elicit an immune response to exogenous genes expressed by a CAVES/virus. The CAVES/viruses administered in the methods provided herein also can elicit an immune response to tumor antigens. Monitoring antibody titer against viral antigens, viral expressed exogenous gene products, or tumor antigens can be used in methods of monitoring the toxicity of a virus, monitoring the efficacy of treatment methods, or monitoring the level of gene product or antibodies for production and/or harvesting.

In one example, monitoring antibody titer can be used to monitor the toxicity of a virus. Antibody titer against a virus can vary over the time period after administration of the CAVES/virus to the subject, where at some particular time points, a low anti-(viral antigen) antibody titer can indicate a higher toxicity, while at other time points a high anti-(viral antigen) antibody titer can indicate a higher toxicity. The viruses used in the methods provided herein can be immunogenic, and can therefore elicit an immune response soon after administering the CAVES/virus to the subject.

Generally, a virus against which a subject's immune system can quickly mount a strong immune response can be a virus that has low toxicity when the subject's immune system can remove the virus from all normal organs or tissues. Thus, in some examples, a high antibody titer against viral antigens soon after administering the CAVES/virus to a subject can indicate low toxicity of a virus. In contrast, a virus that is not highly immunogenic can infect a host organism without eliciting a strong immune response, which can result in a higher toxicity of the virus to the host. Accordingly, in some examples, a high antibody titer against viral antigens soon after administering the CAVES/virus to a subject can indicate low toxicity of a virus.

In other examples, monitoring antibody titer can be used to monitor the efficacy of treatment methods. In the methods provided herein, antibody titer, such as anti-(tumor antigen) antibody titer, can indicate the efficacy of a therapeutic method such as a therapeutic method to treat neoplastic disease. Therapeutic methods provided herein can include causing or enhancing an immune response against a tumor and/or metastasis. Thus, by monitoring the anti-(tumor antigen) antibody titer, it is possible to monitor the efficacy of a therapeutic method in causing or enhancing an immune response against a tumor and/or metastasis.

The therapeutic methods provided herein also can include administering to a subject a CAVES that can accumulate in a tumor and can cause or enhance an anti-virus or anti-cell vehicle/anti-CAVES immune response. Accordingly, it is possible to monitor the ability of a host to mount an immune response against viruses or CAVES accumulated in a tumor or metastasis, which can indicate that a subject has also mounted an anti-tumor immune response, or can indicate that a subject is likely to mount an anti-tumor immune response, or can indicate that a subject is capable of mounting an anti-tumor immune response.

The methods provided herein also can include methods of monitoring the health of a subject. Some of the methods provided herein are therapeutic methods, including neoplastic disease therapeutic methods. Monitoring the health of a subject can be used to determine the efficacy of the therapeutic method, as is known in the art. The methods provided herein also can include a step of administering to a subject CAVES as provided herein. Monitoring the health of a subject can be used to determine the pathogenicity of a virus in the CAVES, when administered to a subject. Any of a variety of health diagnostic methods for monitoring disease such as neoplastic disease, infectious disease, or immune-related disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, or reactive protein concentration.

H. Types of Cancers to be Treated

The systems (CAVES) and methods provided herein can be used to treat any type of cancer or metastases, including solid tumors and hematologic malignancies. Tumors that can be treated by the methods disclosed herein include, but are not limited to a bladder tumor, breast tumor, prostate tumor, carcinoma, basal cell carcinoma, biliary tract cancer, bladder cancer, bone cancer, brain cancer, CNS cancer, glioma tumor, cervical cancer, choriocarcinoma, colon cancer, connective tissue cancer, cancer of the digestive system, endometrial cancer, esophageal cancer, eye cancer, cancer of the head and neck, gastric cancer, intra-epithelial neoplasm, kidney cancer, larynx cancer, leukemia, liver cancer, lung cancer, lymphoma, Hodgkin's lymphoma, Non-Hodgkin's lymphoma, melanoma, myeloma, neuroblastoma, oral cavity cancer, ovarian cancer, pancreatic cancer, retinoblastoma, rhabdomyosarcoma, rectal cancer, renal cancer, cancer of the respiratory system, sarcoma, skin cancer, stomach cancer, testicular cancer, thyroid cancer, uterine cancer, and cancer of the urinary system, such as lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, small cell lung cancer, non-small cell lung cancers, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma, granulocytic sarcoma, corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma, cystadenoma, follicular lymphoma, intestinal lymphosarcoma, fibrosarcoma, and pulmonary squamous cell carcinoma, hemangiopericytoma, ocular neoplasia, preputial fibrosarcoma, ulcerative squamous cell carcinoma, preputial carcinoma, connective tissue neoplasia, mastocytoma, hepatocellular carcinoma, lymphoma, pulmonary adenomatosis, pulmonary sarcoma, Rous sarcoma, reticulo-endotheliosis, fibrosarcoma, nephroblastoma, B-cell lymphoma, lymphoid leukosis, retinoblastoma, hepatic neoplasia, lymphosarcoma, plasmacytoid leukemia, swimbladder sarcoma (in fish), caseous lymphadenitis, lung carcinoma, insulinoma, lymphoma, sarcoma, salivary gland tumors, neuroma, pancreatic islet cell tumor, gastric MALT lymphoma and gastric adenocarcinoma.

In some embodiments, the tumor is selected from metastatic melanoma; esophageal and gastric adenocarcinoma; cholangiocarcinoma (any stage); pancreatic adenocarcinoma (any stage); gallbladder cancer (any stage); high-grade mucinous appendix cancer (any stage); high-grade gastrointestinal neuroendocrine cancer (any stage); mesothelioma (any stage); soft tissue sarcoma; prostate cancer; renal cell carcinoma; lung small cell carcinoma; lung non-small cell carcinoma; head and neck squamous cell carcinoma; colorectal cancer; ovarian carcinoma; hepatocellular carcinoma; and glioblastoma. In some embodiments, the tumor is selected from: glioblastoma, breast carcinoma, lung carcinoma, prostate carcinoma, colon carcinoma, ovarian carcinoma, neuroblastoma, central nervous system tumor, and melanoma.

I. EXAMPLES

The following examples are included for illustrative purposes only and are not intended to limit the scope of the subject matter.

Example 1

Vaccinia Virus has Tumor Selectivity and can be used as a Backbone to Express Recombinant Viruses bearing Therapeutic Genes This example demonstrates that the CAL1 virus, which is a Vaccinia virus obtained by amplifying ACAM2000, is tumor selective and can be used to engineer recombinant viruses expressing therapeutic genes.

Materials and Methods (1) Virus and Cell Culture

CAL1 was amplified from ACAM2000, according to a previously described method using CV-1 cells (Monath et al., *Int. J. of Infect. Dis.* 8 (2004)). CAL2, which has TurboFP635 inserted at an intergenic site, was genetically engineered from CAL1 as described in Example 8 below. PC3, DU145, E006AA, and HPrEC cells were purchased from ATCC (Manassas, VA). PC3 cells were maintained in Roswell Park Memorial Institute (RPMI) 1640 medium (Thermo Fisher Scientific, Waltham, MA) supplemented with 10% fetal bovine serum (FBS). DU145 cells were maintained in low-glucose Dulbecco's modified Eagle's medium (DMEM) supplemented with 2 mM L-glutamine and 10% FBS. E006AA cells were maintained in DMEM supplemented with 10% FBS. HPrEC cells were maintained in Prostate Epithelial Cell Basal Medium supplemented with 6 mM L-glutamine, 0.4% extract P, 1.0 μM epinephrine, 0.5 ng/mL rh TGF-a, 100 ng/mL hydrocortisone, 5 g/mL rh insulin, and 5 μg/mL apo-transferrin through the addition of a Prostate Epithelial Cell Growth Kit. CV-1 cells were maintained in high glucose DMEM supplemented with 1% antibiotic solution (Life Technologies, Carlsbad, CA), 2 mM L-glutamine, and 10% heat-inactivated FBS. Cells were grown in an incubator at 37° C., 5% CO2, and in a humidified atmosphere.

(2) Virus Amplification Assay

Cells were plated in 24-well dishes at 90-100% confluency in 0.5 mL of appropriate media containing 2% FBS. At 4-5 hours after plating, cells were synchronously infected in duplicate with CAL1 at MOIs 0.01 and 0.1. At 24 hours post-infection, two wells of each cell line and MOI of the infected cell samples were harvested by scraping with the rubber head of a 1 $m^1$ syringe, transferred to a 1.5 mL tube, and stored at −20° C. until analysis via plaque assay. The same steps were repeated for dishes at 48, 72 and 96 hours. Prior to performing plaque assays, samples were freeze-thawed three times.

(3) Plaque Assays

CV-1 cells were plated in 24-well plates at $2\times10^5$ cells/well one day before the assay. Samples were serially diluted 1:10 in Dulbecco's modified Eagle's medium supplemented with 2% Fetal Calf Serum (FCS) (DMEM2) and 200 μL of each dilution or DMEM2 only was aliquoted in duplets into wells. Following an incubation of 1-2 hours, 1 mL of carboxymethyl cellulose overlay media was added to each well and the plates were incubated for 48+/−6 hours at 37° C. and 5% $CO_2$. Crystal Violet was used to stain cells for 1-4 hours. Once staining was complete, the stain solution was aspirated; wells were washed twice for 1 minute with 1 mL water and air-dried. Plaques were quantified macroscopically or by microscopic evaluation, if needed.

(4) CAL1 in Xenogeneic Human Prostate Tumor Model System 4-6 week old athymic nude male mice were inoculated with $2.5\times10^6$ of PC3 cells subcutaneously in the right flank. When tumors reached an average volume of about 150 $mm^3$ (between 100-200 $mm^3$), mice were randomized based on tumor size and stratified into treatment groups of $1\times10^6$ or $1\times10^7$ PFU of CAL1, or PBS only (n=10/group). Treatment was delivered intratumorally and tumor size was measured twice a week for 14 days. On day 15, animals were sacrificed, tissue samples (e.g. blood, tumor, kidney (pair), liver, lung, intestine, prostrate, testes, bladder, spleen, brain, and heart) were collected, and samples were mixed with protease inhibitor (complete™ Mini Protease Inhibitor Cocktail (Catalog #11836153001 Roche), Millipore Sigma, Burlington, MA) prior to cryopreservation in liquid nitrogen.

(5) Biodistribution Analysis

Cryopreserved samples were thawed at 37° C. in a water bath and vortexed vigorously to break up tissue sample. Samples from five animals per treatment dose ($1\times10^6$ or $1\times10^7$ PFU of CAL1) and three mock treated animals (negative controls) were used in the following analyses. All samples were analyzed by plaque assay as described above. Samples also were prepared for qPCR according to the DNeasy Blood and Tissue kit protocol by Qiagen (Germantown, MD). DNA Quantitation Kit, Fluorescence Assay was used to determine DNA concentration of samples (Sigma-Aldrich, St. Louis, MO). Prepared samples were used in the qPCR analysis below.

(6) Real Time Semiquantitative PCR

Prepared PC3 tumor xenograft samples were analyzed by real time semiquantitative PCR (qPCR), which was carried out using the LightCycler® instrument (Roche, Penzberg, Germany). The manual for the Roche diagnostics SYBR Green kit was adapted for use with PowerUp™ SYBR™ Green Master Mix (Thermo Fisher Scientific, Waltham, MA). Optimal settings were determined by PCR reactions at different settings with a reference plasmid containing the A56R gene from VACV, which had known limits of detection (LOD) and quantification (LOQ). In addition to quantification, melting curve analysis was performed at the end of each run to distinguish between template amplification, matrix effects, or unspecific reactions. An equal amount of DNA from tissue samples was used in reactions. All experimental reactions were performed in duplicate.

A pUC57 plasmid containing a single copy of A56R ORF from ACAM2000 was used as a positive control, to generate a standard curve for the qPCR assays. cDNA was amplified using the A56R primers:

```
                              (SEQ ID NO: 91)
5'-CATCATCTGGAATTGTCACTACTAAA-3'
and

                              (SEQ ID NO: 92)
5'-ACGGCCGACAATATAATTAATGC-3'
```

Quantification was conducted using the LightCycler® Data Analysis software version 3.45 as described in the operator's manual (Roche, Penzberg, Germany).

(7) Guide RNA

Guide RNA (gRNA) target sequence (5'-CGAG-GAAAAGCTGTAGTTAT-3'; SEQ ID NO:95; target sequence for gRNA1, whose sequence is set forth in SEQ ID NO: 1) (Target Intergenic Locus: between ORF-157 and ORF-158). was analyzed using online software (dna20.com/eCommerce/cas9/input). The gRNA was constructed under the control of a U6 promoter in a lentiviral vector with antibiotic resistance to puromycin (Vector Builder, Shenandoah, TX).

(8) Donor Vector

Construction of the donor vector is described in Example 8. The homologous region (HR) to the right (555 bp) and left (642 bp) of the intergenic locus between ORF_157 and ORF_158 (271 bp) were selected based on the ACAM2000 DNA genome sequence (Genebank: AY313847). Multiple cloning sites were added at both ends of each HR to permit insertion of a therapeutic gene of interest. TurboFP635 was flanked by vaccinia virus early-late promoter (pEL) and vaccinia termination signals.

Three constructed fragments (HR-left, TurboFP635, and HR-right) were synthesized (GeneWiz, San Diego, CA) and cloned into the pUC18 vector using an In-Fusion® Cloning Kit (Takara Bio USA, Mountain View, CA). The donor plasmid was confirmed by Sanger sequencing (Retrogen, San Diego, CA).

(9) Cas9HFc Vector

A plasmid containing the Cas9HF1 sequence, without nuclear localization, was synthesized by Vector Builder (Shenandoah, TX) (Kleinstiver et al., Nature 529:490-495 (2016)).

(10) Transfection and Viral Infection $2\times10^6$ CV-1 cells were seeded in a 6-well plate a day before transfection. Cells at 60-70% confluency were transfected with 1 μg each of plasmid encoding Cas9HFc and gRNA using 6 μl of TurboFectin 8.0 transfection reagent (Origene Technologies, Rockville, MD) in 250 μl of opti-DMEM (Thermo Fisher Scientific, Waltham, MA). At 24 hours post-transfection, cells were infected with CAL1 VACV at an MOI of 0.02 in high glucose DMEM supplemented with 2% FBS. Two hours after viral infection, cells were washed with PBS. 1.5 mL DMEM was added to wells and the plate was incubated at 37° C. with $CO_2$ for 30 minutes before being transfected with 2 μg of the donor vector described above. The cells were further incubated at 37° C. with 5% $CO_2$ and in a humidified atmosphere for 24 hours. The mixture of infected/transfected cells was harvested and stored at −80° C. until virus purification and screening.

(11) Virus Purification

The mixture of infected/transfected cells were thawed and then sonicated at maximum magnitude for 30 seconds, three times on/off ice, to release viruses from the cells. 2 μl of released virus per plate was used to infect four confluent CV-1 cell layers in 6-well plates. Two days after infection, 4-6 positive (red) plaques were picked up under 2× fluorescence microscopy and transferred to cryovials containing 200 μl serum-free DMEM. The purification process was repeated 2-4 times to obtain pure clones.

(12) PCR

Insertion of the transgene was confirmed as described in Example 8 below. To confirm the insertion of the transgene (TurboFP635) at the intergenic locus, primer pairs were designed to amplify the whole intergenic area, with:

```
                                   (SEQ ID NO: 41)
Reverse 5'-GACGAAGAAGCAAGAGATTGTGT-3';
and

                                   (SEQ ID NO: 42)
Forward 5'-ACCGTTTCCATTACCGCCA-3'
```

located on the left and right HR.

The PCR products of the purified clones were analyzed by Sanger sequencing (Retrogen, San Diego, CA).

Results (1) CAL1 Sequence

The original clonal vaccine, ACAM2000, was amplified using CV-1 cells; the resulting derivative was named CAL1. Next generation sequencing (NGS) was used to determine whether there were genetic differences between CAL1 and the parental ACAM2000 vaccine. The results indicated that, when compared to the published ACAM2000 sequence (SEQ ID NO:70), GBAY313847, CAL1 (SEQ ID NO:71) i) had a single nucleotide polymorphism (SNP) within a non-coding region of the inverted terminal repeat (ITR) sequence at position 32 of the CAL1 genome, ii) was shortened by 6 bps in the left ITR and iii) was shortened by 197 bps in the right ITR.

(2) Tumor Selectivity of CAL1

Amplification of the CAL1 virus was measured using prostate cancer derived human tumor cell lines PC3, DU145, and E006AA, and, for comparison, the non-tumor human primary prostate epithelial cell line HPrEC. The African green monkey kidney cell line CV-1, which was used to manufacture CAL1, was included as a positive control. Briefly, cells were infected with CAL1 at an MOI of 0.01 and 0.1. The amplification of live viral particles was examined in the cell lines by plaque assay at 24, 48, 72, and 96 hours. After 96 hours, viral amplification in the infected cells was compared and analyzed between the tumor cells (e.g., PC3, DU145, and E006AA) and non-tumor cells (e.g., HPrEC). The analyses indicated that all the human tumor cell lines showed higher virus amplification at both MOI and at all the times tested, compared to the non-tumor cell line. The human tumor cell line E006AA showed the highest viral amplification of CAL1. The PC3 and DU145 tumor cells showed similar levels of virus amplification, amplification in the PC3 cells being slightly (less than 2 fold) higher than DU145. The non-tumor HPrEC cells showed the least amount of amplification of CAL1:about 5-10 fold less than the DU145 cells and about 50 fold less than E006AA cells. These results demonstrate findings preferential amplification of CAL1 in tumor derived cell lines, compared to primary (non-tumor) cells derived from the same tissue.

(3) Intratumoral Administration of CAL1 Induces Tumor Regression

The anticancer therapeutic potential of CAL1 was analyzed using a xenogeneic human prostate tumor model system. Briefly, prostate tumors were generated by injecting $2\times10^6$ aggressive metastatic human prostate cancer PC3 cells subcutaneously into the right flank of 4-6 week old athymic nude mice. When the volume of the tumors measured an average of about 150 $mm^3$ (15 days post-injection of the PC3 cells; Day 0 of treatment) the mice were injected intratumorally with 1×106 or $1\times10^7$ PFU of CAL1, or, as a control, PBS (n=10/treatment). Following injection, tumor volumes were measured twice a week for the duration of the experiment (up to Day 15 post treatment). The results showed that a single intratumoral injection of CAL1 induced significant inhibition of human PC3 tumor growth: at Day 15, the control tumor size measured about 1450 $mm^3$, relative to a tumor size of about 800 $mm^3$ with $1\times10^6$ PFU of CAL1 and a tumor size of about 550 $mm^3$ with $1\times10^7$ PFU of CAL1. The therapeutic efficacy was found not to be associated with treatment-related mortality or compromised safety, despite the immunocompromised background of the animals.

(4) CAL1 Injected Intratumorally does not Cause Systemic Viremia

The biodistribution and virus amplification potential of CAL1 was analyzed, to determine its tumor selectivity and assess whether there were negative effects on normal tissues. The athymic nude mice discussed above were sacrificed 15 days after treatment. 12 tissue samples were harvested per animal (blood, tumor, brain, heart, kidneys (pair), liver, lung, intestines, bladder, prostate, testes) and cryopreserved in liquid nitrogen. Samples were examined by plaque assay as well as real time semiquantitative PCR (qPCR). The presence of viral DNA or infectious particles were analyzed in animals treated with 1×106 or 1×107 PFU of CAL1 (n=5 for each dose) and animals without virus treatment were used as negative controls (n=3). The analyses revealed a significant amount of virus in the PC3 tumors of all infected animals that were treated with CAL1, compared to the normal tissues in the animals. Specifically, plaque assays showed live virus particles, while qPCR analyses showed high levels of viral DNA in the treated PC3 tumors. The amount of virus in tumor tissue was significantly higher than in any other tissues or organs tested (104-105 pfu/mg virus in the treated PC3 tumors relative to 0-300 pfu/mg virus in the normal tissues; 106-108 copies of viral DNA per PC3 tumor sample relative to background levels in the normal tissue samples), indicating an acceptable safety profile of CAL1 after intratumoral administration.

(5) Increased Therapeutic Potential in Viral Strains Engineered from CAL1

A recombinant virus was engineered in which a 92 bp fragment found in the intergenic area between ORF_157 and ORF_158 was replaced by TurboFP635 using a CRISPR/Cas9 system with a high fidelity cytosolic Cas9 protein (Kleinstiver, B. P., et al., High-fidelity CRISPR-Cas9 nucleases with no detectable genome-wide off-target effects. Nature 529 (7587): 490-495 (2016); see Example 8). PCR and Sanger sequencing confirmed insertion of TurboFP635 in the resulting recombinant virus, which was named CAL2. In addition, microscopy analysis of clones from CV-1 transfected cells showed that TurboFP635 was successfully inserted in the engineered CAL2 recombinant VACV.

Virus amplification of CAL1 and CAL2 was compared in the prostate cancer derived human tumor cell lines PC3, DU145 and E006AA, and the non-tumor human primary prostate epithelial cell line HPrEC, by synchronous infection of the cells at an MOI of 0.01 or 0.1, collection of samples at 24, 48, 72 and 96 hours post-infection, freeze/thawing of the samples, infection of CV-1 cells for 1-2 hours, and quantifying the plaques on the CV-1 cells. The CV-1 cells, which were used to manufacture the CAL2, were used as a positive control. The human tumor cell lines showed very high virus amplification for both CAL1 and CAL2, with levels of plaque forming units per cell of →10. In all three human tumor cell lines tested, no significant differences in virus amplification were observed based on the MOI used for infection. HPrEC showed minimal virus amplification with CAL1 and CAL2 compared to the human tumor cell lines examined. The results demonstrate that the introduction of exogenous genes (such as the exemplary TurboFP635) at the intergenic site between ORF_157 and ORF_158 does not compromise the natural tumor selectivity of the CAL1 virus; both CAL1 and CAL2 show similar preferential amplification in tumor cells compared to non-tumor primary cells derived from the same tissue of origin. The results indicate that CAL1 can be used as a backbone to engineer recombinant viruses bearing therapeutic genes.

Example 2

Inactivation of Vaccinia Virus by Human Serum and Canine Serum

Following the in vivo administration of oncolytic viruses, for example, vaccinia virus (VACV or VV), to humans and animals, the complement system and, in the case of patients with preexisting immunity, neutralizing antibodies, inactivate the administered virus and create an immune barrier to viral therapy. As demonstrated below, this barrier occurs in human and canine serum, although the magnitude of the barrier varies according to species.

A. Virus Plaque Assay (VPA) for Measuring Inactivation of the Vaccinia Virus

The inactivation of vaccinia virus in the presence of serum was measured by Virus Plaque Assay (VPA). VPA is used to measure the virus titer or concentration of viruses in a sample. For example, VPA can be used to quantify virus particle amplification under different conditions, e.g., to compare live virus recovery after exposure of the virus to serum vs. control conditions under which the virus is not incubated with serum.

Virus containing samples are stored at −80° C. and subjected to a three-fold freeze (−80° C.)/thaw (+37° C.) cycle followed by sonication on ice-cold water for three 1 min intervals, one min apart. Sonicated samples are serially diluted in vaccinia virus infection medium (DMEM supplemented with 2% FBS, L-Glutamine and Penicillin/Streptomycin). Plaque assays are performed in 24-well plates in duplicate wells. Briefly, 200,000 CV-1 monkey kidney cells are plated in 1 mL D10 medium per well, overnight. Supernatants are aspirated and 10-fold serial dilutions of the virus-containing sample are applied to the CV-1 monolayer at 200 μL/well. Plates are incubated for 1 h at 37° C. (incubator) with manual shaking every 20 min. 1 mL CMC medium is layered gently on top of the cells and plates are incubated for 48h. CMC overlay medium is prepared by autoclaving 15 g Carboxymethylcellulose sodium salt (Sigma-Aldrich, C4888) and re-suspending with overnight stirring at RT in 1 L DMEM, supplemented with Penicillin/Streptomycin, L-Glutamine, and 5% FBS, with short-term storage at 4° C. Plaques are counted after fixing the cells by topping the wells with Crystal Violet solution (1.3% Crystal violet (Sigma-Aldrich, C6158), 5% Ethanol (Pure Ethanol, Molecular Biology Grade, VWR, 71006-012), 30% Formaldehyde (37% v/v formaldehyde, Fisher, cat #F79-9), and double distilled water) for 3-5 h at room temperature, followed by washing the plates in tap water and drying overnight. The virus titer is calculated in plaque-forming units (PFU) per sample.

B. Human Serum Inactivates Vaccinia Virus-Based Cancer Vaccines

To evaluate the inactivation of VACV in humans by complement and neutralizing antibodies, human serum from a healthy, non-vaccinated donor (h1) and human serum from a healthy, vaccinated donor (h2) were incubated with a clinically relevant dose of plaque-purified ACAM2000, a wild type thymidine kinase (TK)-positive Wyeth strain of VACV. The serum from h1 contained only complement, whereas the serum from h2 contained complement and neutralizing antibodies, due to the donor being previously immunized by vaccination against smallpox using vaccinia virus.

Briefly, $1\times10^3$ plaque-forming units (pfu) of VACV was incubated with 100 uL DMEM culture medium containing 90% human serum from donors h1 or h2, for 1 hour, at 37° C. This concentration corresponds to a clinically relevant viral dose of 5 x 107 pfu, when injected intravenously into an adult weighing 75 kg and having 5 liters of blood. DMEM culture medium alone (no serum) was used as a control. To assess the specific role of complement on serum-mediated viral inactivation, the VACV also was incubated with heat-inactivated serum from donors h1 and h2, in which complement was denatured/non-functional.

Following the 1 hour incubation with serum, the percentage of live virus recovered in comparison to the control (virus incubated without serum) was recorded by performing a plaque assay as described above and comparing the amount of PFU obtained, in a monolayer of CV-1 cells, when the virus was incubated with serum compared to the control in which the virus was not incubated with serum. Serial dilutions were performed so that less than 3% human serum was present in any given dilution in the plaque assay. The results are shown in Table X1 below:

TABLE X1

Inactivation of VACV by human serum

| Conditions | % Recovered PFU relative to non-serum treated virus |
|---|---|
| Control (DMEM, no serum) | 100 |
| Virus + h1 serum | 4 |
| Virus + heat-inactivated h1 serum | 69 |
| Virus + h2 serum | 0 |
| Virus + heat-inactivated h2 serum | 11 |

The results show that human serum from the non-vaccinated (h1) and vaccinated (h2) donors inactivates VACV strain ACAM2000. This indicates that human serum presents a significant barrier to therapeutic efficacy, particularly when an oncolytic virus is administered intravenously (I.V.) or intratumorally (I.T.). Serum from vaccinated donor h2, which contained neutralizing antibodies in addition to complement, inactivated VACV to a greater extent than serum from h1, which did not contain neutralizing antibodies.

Heat inactivation of h1 and h2 sera, which denatures complement proteins and destroys complement activity, significantly reduced the degree of viral inactivation in comparison to h1 and h2 sera that were not heat-inactivated. This confirms that the complement system plays a role in serum-induced viral inactivation. Following heat inactivation of h1 serum, which did not contain neutralizing antibodies, the percentage of live VACV recovered was higher than the percentage of VACV recovered from the non-heat inactivated h1 serum. In contrast, heat inactivation of serum from the vaccinated donor h2, which contained complement and neutralizing antibodies, resulted in only a slight increase in recovered live VACV. Thus, the presence of neutralizing antibodies and/or other serum components, in addition to complement, also plays a role in serum-induced VACV inactivation.

These results demonstrate that VACV is inactivated by human serum following in vivo administration, demonstrating the need for systems that protect VACV in order to provide for or enhance the efficacy of delivery and treatment with oncolytic viruses.

C. Canine Serum Inactivates Vaccinia Virus-Based Cancer Vaccines

Similar to the effects seen in humans, viral vaccines injected into canines encounter initial immune barriers that reduce the efficacy of delivery and treatment. To examine the effects of serum on the inactivation of VACV in canines, a strain interchangeably designated L14 or CAL14, a genetically engineered VACV LIVP strain encoding the fluorescent protein TurboFP635 (TK-inserted), was incubated with serum samples from three different canines.

$1\times10^3$ pfu of CAL14 was incubated with 100 μL of DMEM containing 90% canine serum from three different donors (c1, c2 and c3), for 1 hour at 37° C. This concentration corresponds to an intravenous injection of $2\times10^7$ pfu VACV into a dog weighing 25 kg and having 2 liters of blood. Virus incubated with human serum from donors h1 and h2 (discussed above) was used as a positive control, and virus incubated with DMEM culture medium alone (no serum) was used as a negative control. To analyze the role of complement in the serum-mediated inactivation of virus, CAL14 also was incubated with heat-inactivated serum from the canine and human donors. Following the 1 hour incubation, the percentage of live virus recovered in comparison to control (virus incubated without serum) was recorded using the plaque assay as described above. The results are shown in Table X2 below:

TABLE X2

Inactivation of VACV by canine serum

| Sample | % Recovered PFU relative to non-serum treated virus |
|---|---|
| Control (DMEM, no serum) | 100 |
| Virus + h1 serum | 4 |
| Virus + heat-inactivated h1 serum | 69 |
| Virus + h2 serum | 0 |
| Virus + heat-inactivated h2 serum | 11 |
| Virus + c1 serum | 15 |
| Virus + heat-inactivated c1 serum | 55 |
| Virus + c2 serum | 20 |
| Virus + heat-inactivated c2 serum | 39 |
| Virus + c3 serum | 38 |
| Virus + heat-inactivated c3 serum | 42 |

Compared to the non-serum control (DMEM+CAL14 virus), the percentage of live virus recovered after serum incubation decreased in all human and canine serum samples. These results indicate that human and canine sera inactivate the CAL14 vaccinia virus. Heat inactivation of all serum samples reduces the degree of viral inactivation, demonstrating that the complement system plays a role in the serum-mediated inactivation of viruses, as exemplified in canines and humans. Canine serum initially inactivates VACV following in vivo viral administration (I.V. or I.T.), demonstrating the need for systems that protect VACV, in order to enhance the efficacy of delivery and treatment in canine patients and human patients.

Example 3

Protective Effect of Human and Canine Mesenchymal Stem Cells against Human and Canine Serum-Induced Inactivation of Vaccinia Virus The initial inactivation of in vivo administered oncolytic viruses by serum poses a hurdle to oncolytic virotherapy.

This inactivation partially can partially be compensated or addressed by increasing the injected dose of virus and/or by treating the patient systemically with a complement inhibitor. These approaches, however, can lead to undesirable side effects and toxicity.

Oncolytic viruses can be protected against complement and other inactivating agents present in the blood or the tumor microenvironment by delivering them in carrier cells, such as mesenchymal stem cells (MSCs). Human stromal vascular fraction (SVF), which is derived from whole lipo-aspirates, contains supraadvential-adipose stromal cells (SA-ASC) and other populations that, in culture, can expand and generate adipose-derived mesenchymal stromal cells and/or stem cells (AD-MSCs) that can be used as a source of carrier cells for vaccinia and other viruses. The use of fresh SVF and AD-MSC as cell-based carriers to protect VACV against serum-induced inactivation was evaluated in humans and canines.

A. Preparation of SVF

SVF derived from whole lipo-aspirates alleviates the need for the extensive processing of cells and minimizes the number of steps, thereby reducing the risk for contamination. SVF contains mononuclear cells derived from adipose tissue and is acquired through a simple isolation procedure whereby fat is lipo-aspirated and subjected to enzymatic digestion. Human SVF contains several different cell populations, including CD34+SA-ASC, which can attach to cell culture plastic and proliferate (generating AD-MSC, discussed below). Given the abundance of MSCs SA-ASC (AD-MSC precursors) in SVF preparations, SVF can be used to provide cell carriers for oncolytic viruses such as vaccinia virus.

To isolate and prepare the adipose cells and the adipose stromal vascular fraction, the following protocol was used. Local anesthesia, containing 0.5% lidocaine with 1:400,000 epinephrine and 8.4% $HCO_3$, titrated to a pH of 7.4 (generally, 5cc of $HCO_3$ in a total volume of 60cc), was administered to a subject from whom fat was to be removed. The subject then underwent a liposuction procedure using the cell harvesting, and closed system harvesting and processing system sold under the trademark Time Machine® from the Cell Surgical Network® (CSN; Beverly Hills, Ca.). This system includes a fat processing unit (an airtight syringe for liposuction) and a 2.5-3 mm cannula. Following the liposuction, Bacitracin ointment and a Bandaid® bandage were secured over the wound along with a compressive bandage.

The stromal vascular fraction (SVF) containing the adipose-derived stem cells (ADSCs) was prepared in a closed system according to the following protocol:

a. A closed system for harvesting and processing adipose stem cells, such as the CSN Time Machine®, extracts the harvest of fat into a 60cc TP-101 syringe (single use sterile airtight fat processing syringe)
b. Centrifuge at 2800 rpm for 3 min
c. Remove free fatty acids and debris (local/blood) via TP-109 closed system
d. Transfer 25cc of condensed fat to TP-102 syringe (SVF processing syringe)
e. Add pre-warmed (38° C.) 25cc of Roche T-MAX® Time Machine Accelerator (GMP grade collagenase) containing 12.5 Wunsch units of enzyme (1 Wunsch unit=1000 collagen degrading units (CDU))
f. Incubate at 38° C. for 30-45 minutes
g. Centrifuge at 200 g for 4 minutes
h. Remove supernatant fluid except for bottom 3-10 cc
i. Add 50cc D5LR (Lactated Ringer's and 5% dextrose) as a washing solution to remove collagenase residue and centrifuge at 200 g for 4 minutes
j. Repeat 2 more times for a total of 3 washings
k. Remove all supernatant fluid, leaving 3-10 cc of pellet collection—this is the Stromal Vascular Fraction
l. Transfer SVF to labeled 20cc syringe through 100-micron filters
m. The SVF sample is collected and identified for number of cells, viability and to confirm no clumping or debris.
n. The cells are resuspended in 10 mL of DSLR and aliquots diluted 1:6 in Transport Medium supplemented with Platelet Extract.

B. Preparation of AD-MSC

Non-sorted SVF cells in culture can be used to generate MSCs. CD34+SA-ASC quickly attach to the cell culture plastic and, once activated, rapidly proliferate, generating AD-MSC. To generate AD-MSC, SVF cells were cultured in tissue culture treated plastic with DMEM supplemented with 2 mM glutamine and 5% stimulate (platelet extract) at 37° C., 5% $CO_2$ and in a humidified atmosphere. SA-ASC and other MSC precursors attached to the tissue culture treated plastic and, the following day, all non-attached cells were removed.

The medium was aspirated and MSCs attached to the tissue culture plastic were washed once with complete medium. Fresh, complete medium, as described above, then was added and the MSCs were further cultured for one to two weeks at 37° C., 5% $CO_2$ and in a humidified atmosphere. After two to three days, the attached cells acquired a mesenchymal phenotype, being now called AD-MSC, and cells started to exponentially proliferate. One to two weeks later, passage 0 culture was generated, which in turn originates from 20-100 mL of fat (adipose tissue) obtained from mini-liposuctions. The total number of cells generated is patient dependent and varies based on the amount of SVF cells initially put into culture, but typically ranges from 1×106-1×$10^8$ cells, when starting with 2-10 mL of SVF preparation, which in turn originates from 20-100 mL of adipose tissue obtained from mini-liposuctions. The cells can be grown further, reaching up to $1\times10^{10}$-$1\times10^{14}$ cells.

C. Human SVF as Carrier Cells to Protect Virus Against Human Serum Inactivation and facilitate Delivery to Tumor Cells The ability of fresh human SVF cells (SVF) to protect VACV against inactivation by human serum, and to deliver the protected VACV to tumor cells, was assessed. CAL14 vaccinia virus was added to freshly isolated SVF cells from two different healthy donors (#1 and #2), at a multiplicity of infection (MOI) of 1, taking into account all the cells present in the SVF preparation. The cells and virus were incubated for 1 hour at 37° C., with continuous rotation at 20 RPM. The SVF/virus mixture then was incubated with DMEM supplemented with 2 mM glutamine and 20% human serum in an autologous setting for 30 min in a water bath at 37° C., and then the cells were washed 4 times with PBS to remove any free virus. Free virus (not loaded onto cells) was incubated at the same concentration with human serum for 30 min as a control. Free virus that was not incubated with serum was used as a positive control.

Following incubation with human serum, 40,000 pfu of free CAL14 virus or 40,000 pfu of CAL14 virus loaded onto 40,000 SVF cells (MOI 1) were added to A549 human lung carcinoma cell monolayers in a 24-well plate at an MOI of 0.1, and incubated for 24 hours at 37° C., 5% $CO_2$ in a humidified atmosphere. 24 hours post-treatment, the expression of virus-encoded TurboFP635 protein in the A549 cells was detected by fluorescence microscopy on a KEYENCE All-in-one BZ-X700 Series Fluorescence Microscope, using the red filter to detect TurboFP635 protein expression (TRITC channel); the level of expression was used as a direct measure of the amount of virus amplification in the tumor cells.

Relative levels of Virus Infections and Amplification in A549 Cancer Cells After 24 hours: Protective Effect of SVF

| | Control | Human Serum #BH057 | Human Serum #BH058 |
|---|---|---|---|
| Free virus | 100.00% | 8.71% | 18.03% |
| SVF-BH057/VV | 62.70% | 60.86% | n/a |
| SVF-BH058/VV | 57.96% | n/a | 46.42% |

The results demonstrate that free virus was inactivated by human serum from both donors and failed to amplify in tumor cells, as evidenced by the decrease in detected fluorescence. On the other hand, vaccinia virus loaded onto SVF cells was protected against serum-inactivation and efficiently delivered into the tumor cells, where viral replication was detected by observing expression of the TurboFP635 fluorescent protein encoded by the CAL14 virus. Free virus that was not incubated with serum (positive control) displayed potent viral amplification in the tumor cells, confirming that the decrease in fluorescence observed in the free virus+serum samples was due to viral inactivation by the serum, and not because free virus was not delivered to, or failed to replicate in, the tumor cells.

Thus, SVF obtained from liposuction, which contains high amounts of SA-ASC (mesenchymal stem cell precursors), can carry viruses, protect them from neutralization/inactivation by human serum, and efficiently deliver them to the target tumor cells.

D. Protective Effect of Human AD-MSC Cells Against Human Serum Inactivation of Vaccinia Virus and Delivery to Tumor Cells The ability of cultured human AD-MSC cells to protect VACV against inactivation by human serum and deliver the virus to tumor cells was assessed. CAL14 VV was mixed with AD-MSC cells from a healthy human donor at an MOI of 1 and incubated for 1 hour at 37° C., with continuous rotation at 20 RPM. The AD-MSC/virus mixture then was incubated for 30 minutes with 20% serum from healthy donors, in an allogeneic setting. The cells then were washed 4 times with PBS to remove any free virus. Free virus was incubated at the same concentration with human serum for 30 minutes as a control, and free virus that was not incubated with serum was used as a positive control.

Following incubation with human serum, the various treatments (free virus or MSC/VV) were added into A549 tumor cells monolayers in 24 well plates. 40,000 pfu of free CAL14 virus or 40,000 pfu of CAL14 virus loaded onto 40,000 AD-MSC cells (MOI 1) were added to A549 human lung carcinoma cell monolayers in a 24-well plate at an MOI of 0.1, and incubated for 24 hours at 37° C., 5% $CO_2$ in a humidified atmosphere. 24 hours post-treatment, the expression of virus-encoded TurboFP635 protein in the A549 cells was detected by fluorescence microscopy on a KEYENCE All-in-one BZ-X700 Series Fluorescence Microscope, using the red filter to detect TurboFP635 protein expression (TRITC channel); the level of expression was used as a direct measure of the amount of virus amplification in the tumor cells.

Relative Levels of Virus Infection and Amplification in A549 Cancer Cells After 24 Hours: Protective Effect of AD-MSCs

| | Control | Human Serum #BH057 | Human Serum #BH058 |
|---|---|---|---|
| Free virus | 100.00% | 8.71% | 18.03% |
| AD-MSC/VV | 59.60% | 38.89% | n/a |
| AD-MSC/VV | 66.35% | n/a | 43.73% |

The results demonstrate that free virus was inactivated by human serum from both donors and failed to amplify in tumor cells, as evidenced by the significant decrease in detected fluorescence. In comparison, vaccinia virus loaded onto AD-MSC cells was protected against serum-inactivation and efficiently delivered into the tumor cells, where viral replication was detected by observing the expression of the TurboFP635 fluorescent protein encoded by the CAL14 virus. Free virus that was not incubated with serum (positive control) displayed potent viral amplification in the tumor cells, confirming that the decrease in fluorescence observed in the free virus+serum samples was due to viral inactivation by the serum, and not because free virus was not delivered to, or failed to replicate in, the tumor cells.

Thus, cultured AD-MSCs can carry viruses, protect them from neutralization/inactivation by human serum, and efficiently deliver them to the target tumor cells.

E. Protective Effect of Canine AD-MSCs Against Inactivation of Vaccinia Virus by Canine Serum As in humans, the negative impact of serum on the successful delivery of vaccinia viruses to canine tumors can be reduced by increasing the injected dose, or by treating the animal systemically with a complement inhibitor, which can lead to undesirable and toxic side effects. Thus, the ability of cultured canine MSCs to carry and protect vaccinia virus against serum inactivation was evaluated.

CAL14 vaccinia virus was added at an MOI of 1 to adipose-derived MSCs (AD-MSCs) from two different canine donors (MSC3 and MSC4), and the mixture was incubated for 1 hour at 37° C., with continuous rotation at 20 RPM. MSCs loaded with 1,000 pfu of vaccinia virus in 1,000 cells then were incubated with 90% canine serum in DMEM supplemented medium for 1 hour at 37° C., 5% $CO_2$ in a humidified atmosphere at a final volume of 100 μL (per 1,000 cells). This concentration corresponds to a dose of $2\times10^7$ pfu of vaccinia virus, injected into a 25 kg dog with 2 liters of blood. For comparison, 1,000 pfu of free CAL14 virus (unprotected) also was incubated with 90% canine serum under the same conditions. As a control, virus-loaded MSCs and free virus each were incubated with serum-free DMEM for 1 hour under the same conditions. After the 1 hour incubation period, the percentage of recovered vaccinia virus, relative to the non-serum free virus control, was quantified in pfus by plaque assays in CV-1 cell monolayers, as described above. Serial dilutions were performed to have less than 3% of the canine serum in any given dilution in the plaque assay. Each live infected cell produces 1 plaque, and each live free vaccinia virus particle forms 1 plaque. The results are shown in Table X3 below:

TABLE X3

| Protection of VACV against canine serum-induced activation by cultured MSCs | | |
|---|---|---|
| | % Recovered PFU relative to non-serum treated free virus control | |
| Sample | MSC3 (from canine 1) | MSC4 (from canine 2) |
| Free virus + serum-free DMEM (control) | 100.00 | 100.00 |
| Virus-loaded MSCs + serum-free DMEM (control) | 81.25 | 96.88 |
| Free virus + canine serum | 21.88 | 21.88 |
| Virus-loaded MSCs + canine serum | 37.50 | 39.06 |

The results show that, in the absence of serum (controls with serum-free DMEM), the free virus and the MSC-loaded virus were not inactivated. In the presence of canine serum, however, the free, unprotected virus was significantly inactivated, while loading of the virus onto MSCs prior to incubation with serum provided some protection to the virus. These results indicate that adipose-derived canine MSCs can hide and protect vaccinia virus against canine serum-induced inactivation.

F. Cultured Canine AD-MSCs can Enhance Delivery of Vaccinia Virus to Tumor Cells Having demonstrated that cultured canine MSCs can hide and protect vaccinia virus against serum-induced inactivation, the ability of the MSCs to deliver the protected viruses to tumor cells was evaluated. CAL14 vaccinia virus was loaded onto canine adipose-derived MSCs (AD-MSCs) from three different canines (MSC1, MSC2 and MSC3), at an MOI of 1 and incubated with 90% canine serum as described above, for 1 hour. Free vaccinia virus (unprotected) was incubated with canine serum under the same conditions. Following incubation with serum, the virus-loaded cells or free virus were added to A549 tumor cell monolayers at an MOI of 0.5. The final serum concentration in the A549-containing wells was 2%. As a control, each of the vaccinia virus treatments were incubated in serum-free DMEM. Following a 72 hour incubation with tumor cells, the amount of vaccinia virus amplified by the tumor cells was quantified by plaque assay in CV-1 cell monolayers, as described above. The results are shown in Table XX below:

TABLE XX

| % Virus recovered from tumor cells 72 hours post-treatment | |
|---|---|
| Conditions | % Recovered PFU relative to Control recovery at 100%: free virus incubated with DMEM (no serum exposure) |
| Free virus | 28.0 |
| Virus + MSC 1 | 91.7 |
| Virus + MSC 2 | 83.3 |
| Virus + MSC 3 | 112.5 |

The results show that tumor cells treated with free vaccinia virus (not protected by MSCs) that was pre-exposed to canine serum showed reduced viral amplification relative to free vaccinia virus not pre-exposed to serum. These results corroborate the observed initial inactivation of virus by canine serum. On the other hand, tumor cells treated with any of the 3 canine MSCs loaded with vaccinia virus and pre-exposed to canine serum displayed efficient vaccinia virus amplification, which was comparable to that of the non-inactivated free virus (control incubated with DMEM and no serum). These results show that cultured canine MSCs can be used to protect vaccinia virus against serum inactivation and efficiently deliver it to tumor cells.

Example 4

SVF Cell Populations Associated with ACAM2000 Delivery and Amplification

To characterize the SVF-based delivery system of vaccinia virus, the specific cell populations from SVF that carry the virus and deliver it to tumor cells were examined.

A. SFV Cell Populations That Carry ACAM2000

SVF from three different human non-cancer donors (RMSD042, BHSD060 and RMSD043) were incubated with ACAM2000 for 1 hour at 37° C. at an MOI of 1, with continuous rotation at 20 RPM. After the SVF cells were loaded with ACAM2000, the cells were labeled with a panel of antibodies against each of CD235a, CD45, CD34, CD31 and CD146, and stained for viability with propidium iodide (PI). The SVF cells then were sorted by flow cytometry using the FACSAria™ Fusion flow cytometer (BD Biosciences, San Jose, Ca.), based on the expression of the cell surface markers CD235a, CD45, CD34, CD31 and CD146, and following the recommendations of the International Federation for Adipose Therapeutics and Science (IFATS) and the International Society for Cellular Therapy (ISCT) (Bourin et al. (2013) *Cytotherapy* 15:641-648). Only viable cells (propidium iodide (PI) negative) were sorted. Seven distinct cell populations were identified and sorted: erythrocytes (CD235a+); supra adventitial-adipose stromal cells (SA-ASC; CD235a−/CD 45−/CD34+/CD146−/CD31−), which are the main MSC precursors in culture; pericytes (CD235a−/CD45−/CD34−/CD146+/CD31−), which also are MSC precursors in culture; granulocytes (CD235a−/CD45 medium/high, side scatter (SSC) high); lymphocytes (CD235a−/CD45 high, SSC low); monocytes (CD235a−/CD45 high, SSC medium); and endothelial progenitors (CD235a−/CD45−/CD 34+/CD146+/CD31+). The composition (%) of the main cell populations in the three SVF samples is shown in Table X4. The main mononuclear cell populations in the three SVF samples, and the percentage of each, are shown in Table X5.

TABLE X4

| Composition of main cell populations found in SVF from three donors | | | |
|---|---|---|---|
| | % of cells from each donor | | |
| Cell type | RMSD042 | BHSD060 | RMSD043 |
| Erythrocytes | 98.95 | 99.78 | 98.61 |
| SA-ASC | 0.30 | 0.00 | 0.01 |
| Pericytes | 0.07 | 0.01 | 0.00 |
| Granulocytes | 0.27 | 0.15 | 0.07 |
| Lymphocytes | 0.10 | 0.00 | 0.01 |
| Monocytes | 0.00 | 0.00 | 0.00 |
| Endothelial Progenitors | 0.01 | 0.00 | 0.00 |

TABLE X5

| Composition of main mononuclear cell populations found in SVF from three donors | | | |
|---|---|---|---|
| | % of cells from each donor | | |
| Cell type | RMSD042 | BHSD060 | RMSD043 |
| SA-ASC | 34.49 | 1.47 | 5.50 |
| Pericytes | 8.08 | 3.21 | 0.66 |
| Granulocytes | 30.17 | 74.35 | 67.06 |
| Lymphocytes | 10.99 | 1.40 | 9.33 |
| Monocytes | 0.54 | 0.09 | 1.72 |
| Endothelial Progenitors | 0.61 | 0.29 | 0.15 |

The sorted individual cell populations from the SVF then were seeded on top of A549 tumor cell monolayers and incubated for 3 days with a carboxymethyl-cellulose (CMC) layer, which allowed quantification of the plaques formed by sorted-infected cells. Following the 3 day incubation, plaque numbers formed in the A549 monolayers were measured after fixation and staining with crystal violet, to determine the number of cells from each sorted population that were carrying ACAM2000. As shown in Table X6 below, five different cell populations were sorted by flow cytometry and found to carry ACAM2000. The main cell populations from the 3 SVF fractions that carried ACAM2000 were identified as SA-ASC (MSC precursors) and pericytes.

TABLE X6

| % of cells from each SVF cell population carrying ACAM2000 | | | |
|---|---|---|---|
| | % of cells from each donor | | |
| Cell type | RMSD042 | BHSD060 | RMSD043 |
| Erythrocytes | 0.03 | 0.01 | 0.07 |
| SA-ASC | 24.77 | 14.40 | 18.31 |
| Pericytes | 11.38 | 24.46 | 73.47 |
| Granylocytes | 5.05 | 0.72 | 1.68 |
| Lymphocytes | 1.39 | 16.67 | 0.18 |

B. SVF Cell Populations That Allow ACAM2000 Amplification

As described in Example 3 above, SVF can protect vaccinia virus against serum-induced inactivation. Further investigation identified SA-ASCs (MSCs) and pericytes as the main mononuclear cells of the SVF cell populations that carry vaccinia virus. Next, the SVF cell populations capable of efficiently amplifying vaccinia virus were determined.

The main mononuclear cell populations from the fresh SVF preparations were sorted as described above. Individual, live-sorted populations of SA-ASCs (MSC precursor), pericytes, granulocytes, lymphocytes, and monocytes then were seeded in 48-well plates coated with CTS™ CELLstart™ Substrate (ThermoFisher Scientific) cultured in DMEM supplemented with 10% FBS and 2 mM glutamine at 37° C., 5% $CO_2$ in a humidified atmosphere. Sorted cells immediately were infected with TurboFP635-labeled vaccinia virus (CAL14) at an MOI of 1 in cell culture for 5 days. Fluorescence microscopy was used to detect fluorescent protein expression as an indicator of viral amplification.

TurboFP635 accumulation was found exclusively in AD-MSC cells derived from SA-ASC-sorted cells that attached to the cell culture plastic and proliferated in culture, beginning with day 2. Significant fluorescence accumulation was detected 5 days after infection in the AD-MSCs. These data indicate that AD-MSCs generated from SVF and cultured for a few days allow vaccinia virus to amplify, increasing the number of therapeutic viral particles that can be delivered to the tumor site, thus enhancing the therapeutic effect.

Example 5

Cultured Human and Canine MSCs Promote Amplification of Vaccinia Virus and Expression of Virally-Encoded Proteins As shown in the above examples, the use of fresh SVF and cultured adipose-derived MSCs (AD-MSCs) to conceal, protect and deliver vaccinia viruses to tumor cells provides an improvement over using vaccinia virus alone for therapy. As also provided and demonstrated herein (see, e.g., Example 7), the therapeutic efficacy of an oncolytic virus further can be increased if the virus is amplified by the carrier MSCs prior to delivery to the tumor site.

As described above, non-sorted SVF cells in culture can generate MSC cultures. CD34+SA-ASCs quickly attach to the cell culture plastic and, once activated, rapidly proliferate, increasing the number of vaccinia virus carrier cells. It is shown in Example 3 that cultured human and canine MSCs are capable of protecting vaccinia virus against serum inactivation, and delivering virus to tumor cells. As described in Example 4 above, CD34+SA-ASCs were identified as the major cell population isolated from SVF that carry vaccinia virus and, once in culture where they acquired the MSC mesenchymal phenotype, amplify the vaccinia virus.

It next was determined that human and canine expanded MSCs (AD-MSCs) also amplify the virus, in addition to protecting virus from serum inactivation and delivering virus to the tumor cells. To evaluate the level of amplification of vaccinia virus by the AD-MSCs, the genetically engineered CAL14 VV was used.

A. Viral Amplification and Viral Protein Expression in Human Cultured Adipose-Derived MSCs (AD-MSCs)

First, it was determined whether human AD-MSCs are permissive to the expression and accumulation of the fluorescent virally encoded TurboFP635 protein by detecting fluorescence in infected cells. To do this, human adipose-derived AD-MSCs from three different donors (#1, #2 and #3) were mixed with two different concentrations of CAL14 vaccinia virus, at an MOI of 0.1 or an MOI of 1, for 3 hours in DMEM supplemented with 2% fetal bovine serum (FBS) and 2 mM glutamine at 37° C., 5% $CO_2$ in a humidified atmosphere. After 3 hours, the cell culture medium containing free virus was removed and replaced with fresh DMEM, supplemented with 10% FBS and 2 mM glutamine for 48 hours. 48 hours after infection, the fluorescent signal was analyzed. MSCs from the three donors that were not infected with CAL14 virus were used as a control.

The results of the fluorescence microscopy show that the MSCs from all three donors allowed the expression of the fluorescent protein, which also is indicative of active viral amplification. The amount of fluorescent protein expressed varied among the three MSC samples. MSCs from donor #2 displayed the highest levels of fluorescence at both MOI values of 0.1 and 1, while MSCs from donor #3 displayed the lowest levels of fluorescence, and MSCs from donor #1 showed an intermediate level of fluorescence. Thus, MSCs from some donors display a higher capacity for vaccinia virus amplification and/or viral protein expression than others. No fluorescence was observed in the untreated MSC samples.

The amount of vaccinia virus amplified and released by the MSCs into culture medium (supernatant), as well as the number of viral particles amplified but not released by the cells, then was quantified by plaque assay, as described above. The results (Table X7) show that MSCs from all 3 donors amplified and released the vaccinia virus, as indicated by the presence of virus in the cells and the supernatant. The MSCs from the three donors amplified and released the virus to different extents: the cells from MSC donor #2 showed the highest levels of fluorescence at 24 and 48 hours, and secreted the highest levels of virus at 48 hours (Table X7). Overall, the cells from MSC donor #2 displayed the highest total levels of viral amplification at 48 hours, while the cells from MSC donor #1 displayed the lowest total levels of viral amplification. These results indicate that MSCs from different donors display different levels of vaccinia virus amplification and/or viral-encoded protein expression. The low and high levels of viral amplification and viral protein expression can be advantageous; MSCs with low levels of viral amplification and viral protein expression can survive longer in circulation upon intravenous (I.V.) administration; whereas MSCs with higher levels of viral amplification and viral protein expression can deliver a higher dose of vaccinia virus to tumor cells.

TABLE X7

Amplification and release of vaccinia virus by human cultured adipose-derived MSCs (AD-MSCs)

| | PFU/mL | | |
|---|---|---|---|
| | MSC donor # 1 | MSC donor #2 | MSC donor #3 |
| Supernatant | 4.8 × 10e4* | 6.2 × 10e4 | 4.0 × 10e4 |
| Cells | 1.0 × 10e5 | 2.7 × 10e5 | 2.0 × 10e5 |
| Total | 1.5 × 10e5 | 3.3 × 10e5 | 2.4 × 10e5 |

*ex, $10^X$ and 10^x all mean $10^X$ in the Tables and description provided herein B. Viral Amplification and Viral Protein Expression in Canine Cultured Adipose-Derived MSCs (AD-MSCs)

As shown in Example 3, canine cultured MSCs are capable of protecting vaccinia virus from serum-inactivation and delivering it to tumor cells, improving the therapeutic efficacy in comparison to unprotected virus. It next was determined that canine cultured MSCs allow for efficient viral amplification prior to delivery to the tumor site, which further improves their therapeutic usefulness.

CAL14 VV was used to evaluate the expression and accumulation of the virally-encoded fluorescent TurboFP635 protein in infected canine MSCs by analyzing the fluorescent signal. Canine MSCs from three different donors (#1, #2 and #3) were loaded with two different concentrations of CAL14 vaccinia virus, at an MOI of 0.1 or an MOI of 1, for 3 hours in DMEM supplemented with 2% fetal bovine serum (FBS) and 2 mM glutamine at 37° C., 5% $CO_2$ in a humidified atmosphere. After 3 hours, the cell culture medium containing free virus was removed and replaced with fresh DMEM supplemented with 10% FBS and 2 mM glutamine for 48 hours. 48 hours after infection, the fluorescent signal was analyzed. MSCs from the three canine donors that were not infected with virus were used as controls. It was determined that MSCs from all three canines displayed expression of the fluorescent protein, indicating active viral amplification. Similar to the results obtained with human MSCs, the expression of the virally-encoded fluorescent protein was found to vary between the three canine MSC samples, indicating that some canine MSCs amplify vaccinia virus to a greater degree than others. At both MOI values of 0.1 and 1, MSCs from donor #3 showed the highest levels of fluorescence, and MSCs from donor #1 showed the lowest levels. MSCs from donor #2 showed an intermediate level of fluorescence, that was greater at the MOI of 1. The untreated MSC controls did not show any fluorescence.

Next, the amount of vaccinia virus amplified and released by the canine MSCs into culture medium (supernatant), as well as the number of viral particles amplified but not released, were evaluated by plaque assay, as described above. The results are shown in Table X8. It was found that the MSCs from all three canines amplified and released the virus 48 hours after infection, but with varying degrees. MSCs from canine donor #3 secreted the highest amount of virus at 48 hours, and showed the highest levels of fluorescence at 24 and 48 hours. MSCs from canine donor #2 displayed the highest overall level of virus amplification at 48 hours. MSCs from canine donor #1 showed the lowest levels of viral amplification and fluorescent protein expression. These results indicate that each MSC line displays a different level of viral amplification and virally-encoded protein expression and secretion. Both high and low levels of viral amplification and viral protein expression/secretion can be advantageous; MSCs carrying vaccinia virus with lower levels of viral amplification and protein expression (MSC1) can survive longer in circulation if injected intravenously (I.V.), while MSCs with higher levels of viral secretion (MSC2, MSC3) can deliver vaccinia virus faster when injected intratumorally (I.T.).

TABLE X8

Amplification and release of vaccinia virus by canine cultured adipose-derived MSCs

| | PFU/mL | | |
|---|---|---|---|
| | MSC donor # 1 | MSC donor #2 | MSC donor #3 |
| Supernatant | 1.8 × 10e4 | 3.1 × 10e4 | 9.5 × 10e4 |
| Cells | 8.4 × 10e4 | 3.5 × 10e5 | 1.3 × 10e5 |
| Total | 1.0 × 10e5 | 3.8 × 10e5 | 2.2 × 10e5 |

Example 6

Storage of Cells Loaded with Vaccinia Virus

Treatment standardization requires the generation of a large manufactured lot of MSCs loaded with vaccinia virus. Due to the nature of the therapeutic agent (i.e., a live biotherapeutic/biological agent), the requirements for storage and distribution are stringent. Virus-loaded MSCs should be aliquoted and stored under conditions that preserve therapeutic efficacy following long-term storage. For domestic distribution, the biological agent/therapeutic must be kept at a temperature that maintains its potency and stability for 2-3 days, while for international distribution, that time period typically is 7-10 days. Oncolytic virus-loaded cells provides for long-term storage, and, thus a convenient and readily available "off-the-shelf" therapeutic.

A. Evaluation of Protein Expression Levels in Vaccinia Virus-Loaded MSCs Following Storage at 4° C. or in Liquid Nitrogen The effects of storage at 4° C. (e.g., for transportation) and in liquid nitrogen (−196° C.; representing cryopreservation for long-term storage) on adipose derived-MSCs loaded with two vaccinia viruses, CAL2-eGFP (CAL1 recombinant strain expressing eGFP) and L3-TurboFP635 (Lister recombinant strain expressing TurboFP635), were evaluated. Canine adipose-derived MSCs (MSC4) were loaded with a mixture of WT1-eGFP (i.e., CAL2-eGFP) and L3-TurboFP635 at a 1:1 ratio and an MOI of 1, over a period of 2 hours at 37° C., with continuous rotation at 20

RPM. The cells then were washed twice with PBS to remove free virus. The virus-loaded MSC sample was divided into 3 portions: a) 100,000 live cells that were seeded in 6-well plates immediately after infection, without storage ("fresh cells"), as a control; b) 100,000 live cells that were stored at 4° C. for 2 days and then seeded in 6-well plates and; c) 100,000 viable cells that were frozen down at a concentration of 5 million cells/mL of cell cryopreservation medium (Cryostor® CS10, BioLife Solutions) and stored in liquid nitrogen for 2 days, then thawed in DMEM and seeded in 6-well plates. The percent viabilities of the cells immediately prior to seeding them in the plates were 96%, 80%, and 82% for a), b) and c), respectively. Cells were cultured at 37° C. for 48 hours. MSCs from all three conditions attached to the plastic in less than 1 hour, indicating a high degree of cell viability. No fluorescent signal was detected upon cell attachment in any of the three portions, indicating the absence of viral amplification during storage. 48 hours after seeding, the fluorescent signal was analyzed, with a 1-second exposure for all fluorescent channels (green for CAL2 virus expressing eGFP, red for L3 virus expressing TurboFP635).

The results of the fluorescence microscopy show that the expression levels of the fluorescent proteins, eGFP and TurboFP635 encoded by the CAL2 and L3 viruses, respectively, was similar in fresh MSCs and in MSCs that were stored in liquid nitrogen, indicating that cells can be cryopreserved for long-term storage, without affecting their ability to amplify the virus. MSCs stored at 4° C. showed a lower degree of viral protein expression in comparison, indicating a reduced level of viral amplification.

B. Evaluation of Viral Amplification in Vaccinia Virus-Loaded MSCs Following Storage at 4° C. or in Liquid Nitrogen The amount of live viral particles in each of the three samples described above (a, b and c) was quantified by plaque assay, as described above, after 24 and 48 hours. The results, summarized in Table X9 below, showed that storage in liquid nitrogen did not affect the intrinsic amplification potential of the carrier MSC4 cells when compared to the fresh cells. Storage of the virus-loaded cells at 4° C. for 2 days still allowed vaccinia virus to amplify, but to a reduced degree, in comparison to fresh cells and cryopreserved cells. Thus, the virus-loaded cells can be cryopreserved, generating a convenient "off-the-shelf" therapeutic.

TABLE X9

Effects of storage conditions on viral amplification in canine cultured MSCs

| Storage conditions | PFU/well CAL2 virus | PFU/well L3 virus |
|---|---|---|
| Fresh cells, 24 hours | 6.4 × 10e4 | 1.6 × 10e5 |
| 4 °C, 24 hours | 4.8 × 10e4 | 1.2 × 10e5 |
| Liquid nitrogen, 24 hours | 8.4 × 10e4 | 1.8 × 10e5 |
| Fresh cells, 48 hours | 3.2 × 10e5 | 9.0 × 10e5 |
| 4 °C, 48 hours | 2.3 × 10e5 | 4.1 × 10e5 |
| Liquid nitrogen, 48 hours | 5.7 × 10e5 | 8.8 × 10e5 |

C. Delivery of Vaccinia Virus-Loaded MSCs to Tumor Cells Following Storage in Liquid Nitrogen Next, it was determined whether the canine MSC4 cells, loaded with CAL2-eGFP and L3-TurboFP635 and stored in liquid nitrogen, maintained their therapeutic potential after thawing. The cells were loaded with virus and frozen in liquid nitrogen for 2 days, as described above. The frozen vials were thawed at 37° C. and the samples immediately washed with DMEM supplemented with 10% fetal bovine serum (FBS) and 2 mM glutamine. 100,000 viable cells were added to a 6-well plate containing $1\times10^6$ MTH52c canine mammary carcinoma cells and incubated at 37° C., 5% $CO_2$, in a humidified atmosphere for 48 hours. As a control, fresh (non-frozen) canine adipose-derived MSC4 cells were freshly loaded, as described above. The cells then were washed twice with PBS to remove free virus, and 100,000 viable non-frozen cells were added to the canine tumor cells under the same conditions as the frozen cells. The fluorescent signal was analyzed after 48 hours on the green and red channels, to detect CAL2-eGFP and L3-TurboFP635, respectively.

The results show that virus-loaded MSCs that were frozen in liquid nitrogen delivered a similar amount of vaccinia virus to the canine tumor monolayer as the fresh, non-frozen virus-loaded MSCs, demonstrating that long-term storage of virus-loaded carrier cells in liquid nitrogen is feasible. As a result, live biological treatments can be cryopreserved, allowing for standardization and distribution, and facilitating use in a larger number of cancer patients.

Example 7

Ex-Vivo Culturing of Mesenchymal Stem Cells Carrying Vaccinia Virus Overcomes Immune System Barriers Presented by Tumor Cells and Increases Therapeutic Efficacy As shown above, carrier cells, such as MSCs, can protect vaccinia viruses against serum-induced inactivation. In autologous and allogeneic settings, infected carrier cells are recognized and eliminated by humoral and cell-mediated immunity. Thus, in a clinical scenario, cell carriers can be eliminated by the immune system before the viruses can be amplified or express their encoded proteins, decreasing the delivered dose and treatment efficacy. This example demonstrates a solution to this problem. A cell carrier can be incubated with the virus ex vivo for an amount of time that facilitates viral amplification, and the accompanying expression of one or more viral immunomodulatory proteins, which provides additional protection against humoral and cell-mediated immunity. Exemplary vaccinia virus viral immunomodulatory proteins are set forth in Table X10 below:

TABLE X10

Expression of immunomodulatory proteins by Wyeth and LIVP VV Strains

| Gene | Host target/function | Strain-dependent gene expression: Wyeth | Strain-dependent gene expression: L-IVP |
|---|---|---|---|
| VCP (C3L) | α-Complement (serum) | Wild type | Wild type |
| B5R | α-Complement (serum) | Wild type | Wild type |
| HA (A56R) | α-Natural killer cells | Wild type | Wild type |
| B18R/B19R | α-IFNα/β | <50% activity | Deleted |

TABLE X10-continued

| Expression of immunomodulatory proteins by Wyeth and LIVP VV Strains | | | |
|---|---|---|---|
| | | Strain-dependent gene expression | |
| Gene | Host target/function | Wyeth | L-IVP |
| B8R | α-IFNγ | Wild type | Wild type |
| CmrC | α-TNFα | Deleted | Wild type |
| CmrE | α-TNFα | Deleted | Wild type |

A. Effects of Extended Incubation Times on Virus-Loaded MSC Viability and Functionality Vaccinia virus strain CAL2-Opt1, a genetically engineered CAL1 strain encoding the fluorescent protein TurboFP635, was incubated for 1, 2, 6 and 24 hours at an MOI of 1 with human adipose-derived MSCs (AD-MSCs) in DMEM supplemented with 2 mM glutamine at 37° C., in suspension, at a continuous rotation of 20 RPM. AD-MSCs then were collected, as described below, 1, 2, 6 and 24 hours post infection and cryopreserved to generate treatment lots. The treatment lots collected 1 and 2 hours post-infection were designated MSC/VV-1 and MSC/VV-2, respectively. The treatment lots collected 6 and 24 hours post treatment had sufficient time for the virus to express immunomodulators in the MSCs (i.e., ex vivo in the cell vehicle rather than at the tumor delivery site); these lots, referred to herein as "CAVES," (Cell-Assisted Viral Expression System), were designated as CAVES-6 and CAVES-24, respectively.

To generate the MSC/VV-1 treatment lot, cells incubated with VV for 1 hour were washed twice with PBS, cryopreserved in Cryostor® CS10 and stored as a vial in liquid nitrogen for 1 week. To generate the MSC/VV-2 treatment lot, cells incubated with VV for 2 hours were washed twice with PBS, cryopreserved in Cryostor® CS10 and stored as a vial in liquid nitrogen for 1 week. To generate the CAVES-6 and CAVES-24 treatment lots, AD-MSCs were incubated with VV for 2 hours with continuous rotation, then were cultured in DMEM supplemented with 2 mM glutamine and 5% platelet extract at 37° C., 5% $CO_2$ in a humidified atmosphere. 4 hours or 22 hours after seeding, cells were trypsinized, washed twice with PBS, cryopreserved in Cryostor® CS10 and stored as vials in liquid nitrogen for 1 week.

The frozen vials were thawed at 37° C. and the contents immediately were washed with DMEM supplemented with 10% fetal bovine serum (FBS) and 2 mM glutamine. Cell viability was analyzed by Trypan Blue and determined to be greater than 90% for all the treatment lots. Fluorescence microscopy then was used to evaluate expression of TurboFP635, which was detected immediately after thawing in the CAVES-24 treatment lot, indicating that viral-encoded protein had already been synthesized and was present in the cells. This can enhance the therapeutic efficacy of oncolytic viruses because, not only will any virus-encoded immunomodulators already be expressed, thereby protecting the cells and virus against the patient's immune system and favoring the initial spread of virus in the tumor, but also any therapeutic proteins encoded by the virus will already be present upon tumor cell infection and can render a therapeutic effect that is immediate or substantially faster than having viral amplification and protein synthesis occur (be initiated) at the tumor site. These results show that CAVES can maintain their ability to synthesize virally-encoded proteins following cryopreservation and thawing.

B. Effects of Complement Inhibition on the Therapeutic Efficacy of MSC/VV and CAVES Treatment Lots To evaluate whether MSC/VV and/or CAVES is/are resistant to complement inhibition, 50,000 cells (equivalent to 50,000 pfu free Vaccinia Virus (VV) which were used to generate the MSC/VV and CAVES at a MOI of 1) of MSC/VV-1, MSC/VV-2, CAVES-6 or CAVES-24 were incubated in 100 μl of a DMEM solution supplemented with 2 mM Glutamine and 10% heat inactivated fetal bovine serum (D10), 90% heat inactivated fetal bovine serum (D90) or 90% human serum (H90). As a control, 50,000 free CAL1-Opt1 free virus were incubated under the same conditions. After the 1 hour incubation period, the percentage of recovered vaccinia PFU (plaque forming virus) or cPFU (infected cell Plaque forming units) after incubation with 90% human serum, relative to that recovered from incubation with 90% heat inactivated fetal bovine serum or 10% heat inactivated fetal bovine serum was quantified by standard plaque assay using monolayers of CV-1 cells and carboxymethyl cellulose (CMC) medium layer; each live infected cell produces 1 plaque (cell Plaque forming Units, cPFU), and each live free vaccinia virus particle forms 1 plaque. Plaques were counted after fixation and staining of the cell monolayers with Crystal Violet.

| % Recovered PFU or cPFU after Incubation with 90% human serum, relative to Control Incubation conditions (90% heat inactivated fetal bovine serum) | |
|---|---|
| Free VV | 14.0 |
| MSC/VV 1 hour | 19.7 |
| MSC/VV 2 hours | 34.5 |
| CAVES-6 | 39.5 |
| CAVES-24 | 100.8 |

The results demonstrate that CAVES offer greater protection against complement inactivation of the virus in the presence of human serum, compared to free virus or virus incubated with MSCs for shorter times of 1–2 hours. With CAVES-24, the amount of plaque recovered after incubation with human serum was the same as the amount recovered after incubation with 90% heat inactivated fetal bovine serum, indicating that the CAVES-24 offer complete protection against complement inactivation.

C. CAVES Potentiate the Therapeutic Effect of Oncolytic Viruses in Tumor Cells

Having demonstrated that CAVES-6 and CAVES-24 can protect vaccinia virus against serum-induced inactivation, the ability of the CAVES to deliver the protected viruses to prostate tumor cells (PC3) was evaluated in the constant presence of 20% human serum, under culture conditions.

MSC/VV and CAVES treatments were thawed and washed once in PBS. 5,000 cells of MSC/VV-1, MSC/VV-2, CAVES-6 or CAVES-24 were added to a 24-well plate containing 500,000 PC3 human prostate cancer cells (MOI 0.01) and incubated with DMEM supplemented with 10% FBS, with or without 20% human serum. As a control, 5,000 free CAL2-Opt1 viruses were added to PC3 cells under the same conditions 24 hours post-treatment, the expression of virally-encoded TurboFP635 protein in the PC3 cells, as an indicator of viral expression in the PC3 cells, was detected by fluorescence microscopy. The results show that, in the absence of serum, PC3 cells treated with free virus amplified the virally-encoded TurboFP635 protein (0.60 intensity/pixel). In the presence of 20% human serum, free virus was inactivated, as indicated by the dramatic drop of fluorescence activity of the virus-encoded protein in tumor cells (0.18 intensity/pixel, 70% inhibition). On the other hand, the therapeutic effect of the viruses remained intact in the presence of 20% human serum when viruses were loaded onto MSCs and incubated for 1, 2, 6 or 24 hours. The efficacies of MSC/VV and CAVES treatment were not diminished in the presence of 20% human serum, when compared to equivalent conditions except in the absence of human serum.

Relative Levels of Virus Infection and Amplification in Prostate Cancer Cells after 24 Hours

| | Control (s.d.) | Serum (s.d.) |
|---|---|---|
| Free VV | 0.60 (0.02) | 0.18 (0.01) |
| MSC/VV 1 hour | 0.90 (0.02) | 1.63 (0.19) |
| MSC/VV 2 hours | 2.21 (0.04) | 3.56 (0.22) |
| CAVES-6 | 1.34 (0.18) | 2.21 (0.12) |
| CAVES-24 | 7.28 (0.65) | 10.17 (0.54) |

In addition to the protective effects of MSC/VV and CAVES against human serum-mediated inactivation of the virus, it was found that the MSC/VV and CAVES displayed higher levels of TurboFP635 expression in the PC3 cells than free virus, indicating an efficient transfer of oncolytic virus into the tumor cells and a head start on amplification of the virus (initially in the MSC, subsequently in the PC3 cells). CAVES-24 displayed significantly higher levels of TurboFP635 expression under the same conditions, indicating that treatment with CAVES-24 can result in the efficient transfer of oncolytic virus to the tumor cells in a short period of time and provide a considerable improvement in treatment efficacy over the free virus alone, MSC/VV-1 or MSC/VV-2. The relative therapeutic potency of CAVES-24 treatment in vitro under conditions containing 20% human serum was more than 5000%, when compared to treatment with the free virus.

Relative Therapeutic Potency in Prostate Cancer Cells in the Presence of Human Serum

| | Relative % Potency |
|---|---|
| Free VV | 100% |
| MSC/VV 1 hour | 885% |
| MSC/VV 2 hours | 1935% |
| CAVES-6 | 1201% |
| CAVES-24 | 5524% |

D. MSC/VV and CAVES Deliver and Amplify Oncolytic Viruses in the presence of Peripheral Blood Mononuclear Cells (PBMCs)

The ability of MSC/VV and CAVES to deliver and amplify oncolytic viruses in the presence of peripheral blood mononuclear cells (PBMCs) was measured in vitro. Briefly, the MSC/VV and CAVES treatment lots described above were thawed and washed once in PBS. 20,000 cells of MSC/VV-1, MSC/VV-2, CAVES-6 or CAVES-24 were added into a 96-well plate containing 250,000 human PBMCs from two different healthy donors, in allogeneic settings, and incubated with RPMI supplemented with 10% FBS, HEPES, 2 mM glutamine and pyruvate.

2, 24 and 48 hours post seeding, the expression of viral-encoded TurboFP635 protein was detected by fluorescence microscopy, as an indicator of virus amplification in the MSC cells. The results show that, in the absence of PBMC, MSC/VV-2 required 24 hours to achieve a fluorescence level similar to that achieved in CAVES-24 within 2 hours of thawing and seeding. These results once again demonstrate that CAVES-24 is a more efficient treatment than MSC/VV. Amplification of the fluorescent signal in MSC/VV-2 was inhibited when PBMCs from donor 1 were present but not when PBMCs from donor 2 were present, indicating an allogeneic rejection of MSC/VV-2 in the presence of PBMCs from donor 1. The CAVES-24 fluorescent signal amplification, however, was not inhibited (measured 24 hours post seeding) when PBMC from either donor 1 or 2 were present. These data show that CAVES permit amplification in the presence of allogeneic PBMCs.

Relative amount VV Amplification in MSCs In Vitro in the Presence of PBMC

| | | 2 h | 24 h | 48 h |
|---|---|---|---|---|
| MSC/VV 2 hours | Ctrl | 0.01 | 0.15 | 0.28 |
| | +PBMC #1 | 0.01 | 0.07 | 0.10 |
| | +PBMC #2 | 0.01 | 0.15 | 0.31 |
| CAVES 24 hours | Ctrl | 0.22 | 0.30 | 0.33 |
| | +PBMC #1 | 0.23 | 0.30 | 0.29 |
| | +PBMC #2 | 0.23 | 0.29 | 0.29 |

The data show that CAVES protect oncolytic viruses against humoral and cell-mediated immunity and, further, amplify and potentiate oncolytic virus therapies by facilitating the initial spread of the virus inside the tumor.

E. Virus Particles/Cell and Genomic Copies Prior to Administration Following Incubation and/or Freezing The number of viral particles per cell were analyzed by plaque assay, after disrupting cells (MSC or CAVES) by three-fold freeze (−80° C.)/thaw (+37° C.) cycle followed by sonication on ice-cold water for three 1 min intervals, one min apart. The number of viral genomes/cell (see below) also were measured because sonication can damage virus particles and could affect accuracy.

The amount of CAL1 viral particles in frozen MSC/CAL1 (2h), CAVES (24h) or CAVES (48h) (hours represent the length of incubation) that were prepared using CAL1 virus at an MOI=1 and adipose-derived MSC was as follows:

| | PFU/cell |
|---|---|
| MSC/CAL1-2 h | 0.00505 |
| CAVES-24 h | 3.18 |
| CAVES-48 H | 2.74 |

The amount of CAL2 viral particles (CAL2-OX40L or Cal2−41BBL) in frozen CAVES (after 24 h incubation) that were prepared using CAL2 virus at an MOI=0.1 and Adipose-Derived MSC was as follows:

| | PFU/cell |
|---|---|
| CAVES-OX40L-24 h | 4.17 |
| CAVES-4-1BBL-24 h | 3.7 |

The PFU/Cell values noted above reflect the amount of viral particles with infective capacity after disruption and sonication of the infected cell or CAVES. These results demonstrate that the CAVES contain 20−50 times more viral particles with infective capacity relative to the MSC and virus in association at shorter incubation times.

Characterization of treatment lots (MSC/VV and CAVES)

To further characterize the treatment lots generated by MSC and vaccinia viruses, the amount of viral genomic DNA copies per cell (MSC) per treatment was analyzed. New frozen stocks of MSC loaded with vaccinia virus (MSC/VV) and CAVES were generated. Treatments containing unmodified amplified/propagated ACAM2000 (CAL-01), or containing recombinant CAL-02.m1, and CAL-02.m2 also were generated.

TABLE X11

Vaccinia Viruses used to generate MSC/VV or CAVES treatments

| Virus name | Recombinant therapeutic |
|---|---|
| CAL-01 | None |
| CAL-02.m1 | mOX40L |
| CAL-02.m2 | m4-1BBL |

Preparation of MSC/VV and CAVES Containing CAL-01

Vaccinia virus strain CAL-01, was incubated for 2 hours (MOI of 1 or 10), for 24 hours (MOI 1), or for 42 hours (MOI 0.1) with human adipose-derived MSCs (AD-MSCs) in DMEM supplemented with 5% FBS, 1% growth factor and 2 mM glutamine at 37° C., in cell culture. AD-MSCs were collected, as described below, 2, 24 or 42 hours post infection and cryopreserved to generate treatment lots. The treatment lots collected 2 hours post-infection were designated as described above MSC/VV-2 (with MOI of 1 or 10). The treatment lots collected at 24 or 42 hours were designated as CAVES-24 and CAVES-42, respectively. To generate the MSC/VV-2 or CAVES-24 or CAVES-42 treatment lot, cells incubated with VV for 2, 24 or 42 hours were washed twice with PBS, cryopreserved in Cryostor® CS10 and stored as vials in liquid nitrogen.

Preparation of MsC/VV and CAVEs Containing CAL-02

Vaccinia virus strain CAL-02.m1 or CAL-02.m2, were incubated for 24 hours (MOI 1), or for 42 hours (MOI 0.1) with human adipose-derived MSCs (AD-MSCs) in DMEM supplemented with 5% FBS, 1% growth factor and 2 mM glutamine, in cell culture. AD-MSCs then were collected, as described above 24 or 42 hours post infection and cryopreserved to generate treatment lots. The treatment lots collected at 24 or 42 hours were designated as CAVES-02.m1-24 and CAVES-02.m2-24 or CAVES-02.m1-42 and CAVES-02.m2-42, respectively.

To generate CAVES-02.m1-24 and CAVES-02.m2-24 or CAVES-02.m1-42 and CAVES-02.m2-42 treatment lots, cells incubated with VV for 24 or 42 hours were washed twice with PBS, cryopreserved in Cryostor® CS10 and stored as vials in liquid nitrogen.

Quantification of Viral Genomic DNA Copies Per Cell on Treatment Lots

The frozen vials were thawed at 37° C. and the contents immediately were washed with PBS. Cell viability was analyzed by Trypan Blue and determined to be greater than 70% for all the treatment lots. Viral Genomic content per cell was determined by quantitative real-time PCR DNA was extracted using the Quick-gDNA™ Blood MidiPrep (Zymo Research, CA). The copy number amount of viral DNA copies relative to human cells was quantified by qPCR using PowerUp™ SYBR& Green Master Mix (Thermo Fisher Scientific, CA) and the following primers for the virus: A56R-F (CAT CAT CTG GAA TTG TCA CTA CTA AA; SEQ ID NO:91), A56R-R (ACG GCC GAC AAT ATA ATT AAT GC; SEQ ID NO:92) and the following primers for the human cells (MSC): GAPDH1-F (GGG AAG GTG AAG GTC GGAGT; SEQ ID NO:93), GAPDH1-R (TCC ACT TTA CCA GAG TTA AAA GCAG; SEQ ID NO:94). Data were recorded and analyzed using an QuantStudio 6 Flex Real-Time PCR System (ThermoFisher Scientific) and QuantStudio Real-Time PCR Software v1.3.

Genomic copies of viral DNA per cell is shown in Table X12. Data as presented takes into consideration that every human cell has 2 copies of GAPDH1.

TABLE X12

Quantification of viral genomic DNA copies per cell on treatment lots

| Name | MOI to manufacture cryopreserved treatment | PFU/cell of final product | Genomic copies of viral DNA/Cell of final product |
|---|---|---|---|
| MSC/CAL1-2 h | MOI 1 | 0.01 | 0.16 |
| MSC/CAL1-2 h | MOI 10 | 0.17 | 3.03 |
| CAVES-24 h | MOI 1 | 3.18 | $3.1 \times 10^3$ |
| CAVES-40 h | MOI 0.1 | 4.55 | $7.2 \times 10^3$ |
| CAVES: OX40L-24 h | MOI 1 | 4.17 | $7.2 \times 10^3$ |
| CAVES: OX40L-40 h | MOI 0.1 | 2.02 | $4.6 \times 10^3$ |
| CAVES: 4-1BBL-24 h | MOI 1 | 3.70 | $5.4 \times 10^3$ |
| CAVES: 4-1BBL-40 h | MOI 0.1 | 1.89 | $5.5 \times 10^3$ |
| CAVES: antiVEGF/OX40L-24 h | MOI 0.2 | 6.14 | $1.1 \times 10^4$ |

Genomic copies of viral DNA per cell provide a direct indication of the number of viruses that potentially can finish a replication cycle inside the cells and can start to be released at time of injection once the viral particle is formed. The data show that CAVES treatments contain a minimum of 1000 copies of viral DNA compared to less than about 5 or fewer copies for the MSC/CAL1. This indicates that the viral amplification cycle inside the cells is more advanced compared to MSC/CAL1-2h. With an MOI of 0.1 to 1, the number of genomic copies of virus DNA in the CAVES is between several 1000 to about 10,000.

Example 8

Engineering Recombinant Oncolytic Viruses with Increased Therapeutic Potential To increase the therapeutic potential of the oncolytic viruses for delivery in accord with the compositions and methods herein, recombinant viruses encoding therapeutic genes were constructed. The virus-encoded therapeutic proteins can exert additional therapeutic effects. If the recombinant viruses are used to generate CAVES as described in Example 7, the encoded therapeutic proteins, which are expressed prior to administration to a subject, can take effect directly upon administration to a subject in need of such treatment.

Vaccinia virus has been used as a platform to express therapeutic genes in tumor cells. The therapeutic genes generally are inserted in the virus genome in a manner that disrupts the expression of one or more viral genes, thereby attenuating the virus and improving tumor selectivity. Such attenuated viruses often lose the capacity to efficiently replicate in tumor cells. In naturally attenuated viruses, further attenuation can decrease their therapeutic potential.

This example describes a new location site in the ACAM2000 Vaccinia Virus at which therapeutic genes can be inserted without altering functional viral open reading frames (ORFs) in the resulting recombinant virus. A small middle fragment (92 bp) of a gap between ORF_157 and ORF_158 (271 bp; SEQ ID NO: 3) was selected to be replaced by gene(s) of interest. As described below, genes of interest were introduced into this intergenic area between ORF_157 and ORF_158 using the CRISPR/Cas9HFc (high fidelity Cas9) system.

1. Cell Culture

African green monkey kidney fibroblast CV-1 cells were cultured in Dulbecco's modified Eagle's high glucose medium, supplemented with 1% antibiotic solution (Life Technologies), 2 mM L-glutamine (Life Technologies) and 10% heat-inactivated fetal bovine serum (Mediatech). Cells were grown in an incubator at 37° C., 5% $CO_2$ and in a humidified atmosphere.

2. Guide RNA for Targeting the Intergenic Locus Between ORF_157 and ORF 158

The guide RNA (gRNA) sequence for CRISPR/Cas9 (SEQ ID NO:1) was selected using online software (dna20.com/eCommerce/cas9/input). The guide RNA was constructed under the control of a U6 promoter in a lentiviral vector (lentivector). Antibiotic resistance to puromycin was included in the lentivector backbone (vector obtained from VectorBuilder, Inc., Shenandoah, TX; SEQ ID NO:2).

3. Construction of Donor Vectors to Generate Recombinant VACV

Homologous regions (HRs) to the right and left of the intergenic locus between ORF 157 and ORF_158 were selected based on the ACAM2000 Vaccinia virus genome sequence (GenBank Accession No: AY313847; SEQ ID NO:70). The intergenic locus between ORF_157 and ORF_158 is a 271 bp sequence (SEQ ID NO: 3), while the two HRs are a 555 bp sequence to the right (SEQ ID NO:4) and a 642 bp sequence to the left (SEQ ID NO:5) of the intergenic locus. Within the intergenic locus is a 92 bp sequence (SEQ ID NO:6) that is replaced by the therapeutic gene of interest.

Donor Vector for TurboFP635 Expressing Cassette (Vector 1)

To construct the donor vector for the VACV expressing TurboFP635, the following DNA fragments were synthesized (Genewiz, Inc., San Diego, CA):

(a) (upstream) MCS1 (multiple cloning site 1, Mfel, PstI)→HR (left) (SEQ ID NO: 7) (downstream);

(b) (upstream) MCS2 (multiple cloning site 2, SacI, Ncol, BmtI)→loxP →DNA encoding far red fluorescent protein TurboFP635 flanked by VACV early/late promoter upstream (pEL) and Vaccinia transcription termination signals →loxP →MCS3 (multiple cloning site 3, BamHI, SphI, EcoRV, Swal, NotI, Sacl) (downstream) (SEQ ID NO:8); and (c) HR (right) (SEQ ID NO:4).

The fragments were cloned in the order (a)≥(b)→(c) (upstream →downstream) into a pUC18 vector (SEQ ID NO: 72) using an in-fusion cloning kit (Takara Bio USA, Inc., Mountain View, CA), resulting in the vector pIg-loxP-TurboFP635 (SEQ ID NO:9). The sequence of the resulting donor plasmid was confirmed by Sanger sequencing (Retrogen, Inc., San Diego, CA) Donor Vector for Generating Recombinant VACV Expressing Anti-VEGF scAb(Vector 3)

The donor vector was constructed by linearizing Vector 1 using SphI restriction enzyme and inserting DNA encoding a single chain antibody against VEGF (scAb(VEGF); SEQ ID NO:10) linked to DNA encoding an IgK signal peptide (SEQ ID NO:11), which facilitates cellular secretion of the antibody, and DNA encoding a FLAG tag (SEQ ID NO:29), which facilitates detection. The IgK-scAb (VEGF)-FLAG sequence was codon-optimized for expression in Vaccinia virus (e.g., idtdna.com/CodonOpt) and placed under the control of Vaccinia late promoter (pL; SEQ ID NO:20). The resulting vector containing the loxP→pEL→ TurboFP635 –≥loxP→pL→IgK→scAb(VEGF)→FLAG sequence (upstream→downstream) was synthesized by Genewiz, Inc. (SEQ ID NO:12). The sequence of the vector was confirmed by Sanger sequencing (Retrogen, Inc., San Diego, CA). The TurboFP635 cassette can be used as a selection gene and can be excised as needed using loxP/CRE recombinase.

Donor Vector for Generating Recombinant VACV Expressing Human Sodium Iodide Symporter (hNIS) and TurboFP635 (Vector 4)

The donor vector was constructed by linearizing Vector 1 using SphI restriction enzyme and inserting DNA encoding the human sodium iodide symporter (hNIS) (SEQ ID NO:14) under control of the Vaccinia early promoter (pE) (SEQ ID NO: 15). The resulting vector containing the loxP→pEL→TurboFP635 →1oxP →pE→hNIS sequence (upstream→downstream) was synthesized by Genewiz, Inc. (SEQ ID NO:13). The sequence of the vector was confirmed by Sanger sequencing (Retrogen, Inc., San Diego, CA). The TurboFP635 cassette can be used as a selection gene and can be excised as needed using loxP/CRE recombinase.

Donor Vectors for Generating Recombinant VACV Expressing Checkpoint Inhibitors and a Selection Gene (TurboFP635)

(1) Single Chain Antibody Against Human CTLA-4 and TurboFP635 (Vector 5)

The donor vector was constructed by linearizing Vector 1 using SphI restriction enzyme and inserting DNA encoding a single chain antibody against human CTLA-4 (h-scAb (CTLA-4)) (SEQ ID NOs: 16 or 17) linked to DNA encoding an IgK signal peptide (SEQ ID NO:18), which facilitates cellular secretion of the antibody, and DNA encoding a FLAG tag (SEQ ID NO:29), which facilitates detection. The IgK-h-scAb(CTLA-4) sequence was codon-optimized for expression in Vaccinia virus (idtdna.com/CodonOpt) and placed under the control of Vaccinia early/late promoter (pEL) (SEQ ID NO:74). The resulting vector containing the loxP→pEL→TurboFP635–→10xP →pEL→IgK→h-scAb (CTLA-4))→FLAG sequence (upstream→downstream) was synthesized by Genewiz, Inc. (SEQ ID NO: 30, using the sequence of SEQ ID NO: 17 for h-scAb(CTLA-4)). The sequence of the vector was confirmed by Sanger sequencing (Retrogen, Inc., San Diego, CA). The TurboFP635 cassette can be used as a selection gene and can be excised as needed using loxP/CRE recombinase.

(2) Single Chain Antibody Against Murine CTLA-4 and TurboFP635 (Vector 6)

The donor vector was constructed by linearizing Vector 1 using SphI restriction enzyme and inserting DNA encoding a single chain antibody against murine CTLA-4 (m-scAb (CTLA-4); SEQ ID NO:21) linked to DNA encoding an IgK signal peptide (SEQ ID NO:18), which facilitates cellular secretion of the antibody, and DNA encoding a FLAG tag (SEQ ID NO:29), which facilitates detection. The IgK-m-scAb(CTLA-4) sequence was codon-optimized for expression in Vaccinia virus (idtdna.com/CodonOpt) and placed under the control of Vaccinia early/late promoter (pEL) (SEQ ID NO:74). The resulting vector containing the loxP→pEL→TurboFP635 →loxP→pEL→IgK→m-scAb (CTLA-4))→FLAG sequence (upstream→downstream) was synthesized by Genewiz, Inc. (SEQ ID NO: 31). The sequence of the vector was confirmed by Sanger sequencing (Retrogen, Inc., San Diego, CA). The TurboFP635 cassette can be used as a selection gene and can be excised as needed using loxP/CRE recombinase.

(3) OX40L (Murine-Vector 7, Canine-Vector 8 and Human-Vector 9) and TurboFP635

The donor vectors were constructed by linearizing Vector 1 using SphI restriction enzyme and inserting DNA encoding murine OX40L (SEQ ID NO:22), canine OX40L (SEQ ID NO:23) or human OX40L (SEQ ID NO:24) under control of the Vaccinia early/late promoter (pEL) (SEQ ID NO:74). The resulting vectors containing the loxP→pEL→TurboFP635 →loxP →pEL→OX40L (murine, canine or human) sequence (upstream→downstream) were synthesized by Genewiz, Inc. (SEQ ID NOs: 32, 33 and 34, for murine (vector 7), canine (vector 8) and human (vector 9) OX40L, respectively). The sequences of the vectors were confirmed by Sanger sequencing (Retrogen, Inc., San Diego, CA). The TurboFP635 cassette can be used as a selection gene and can be excised as needed using loxP/CRE recombinase.

(4) 4-1BBL (Murine-Vector 10, Canine-Vector 11 and Human-Vector 12) and TurboFP635

The donor vectors were constructed by linearizing Vector 1 using SphI restriction enzyme and inserting DNA encoding murine 4-1BBL (SEQ ID NO:25), canine 4-1BBL (SEQ ID NO:26) or human 4-1BBL (SEQ ID NO:27) under control of the Vaccinia early/late promoter (pEL) (SEQ ID NO:74). The resulting vectors containing the loxP→pEL→TurboFP635 →loxP →pEL→4-1BBL (murine, canine or human) sequence (upstream→downstream) were synthesized by Genewiz, Inc. (SEQ ID NOs: 35, 36 and 37, for murine (vector 10), canine (vector 11) and human (vector 12) 4-1BBL, respectively). The sequences of the vectors were confirmed by Sanger sequencing (Retrogen, Inc., San Diego, CA). The TurboFP635 cassette can be used as a selection gene and can be excised as needed using loxP/CRE recombinase.

Donor Vectors Encoding Two Therapeutic Genes and a Selection Gene (TurboFP635)

(1) 4-1BBL and OX40L (Murine-Vector 13, Canine-Vector 14, Human Vector 15)

The donor vectors were constructed by linearizing Vector 1 using SphI restriction enzyme and inserting DNA encoding murine 4-1BBL (SEQ ID NO:25), canine 4-1BBL (SEQ ID NO:26) or human 4-1BBL (SEQ ID NO:27) under control of the Vaccinia early/late promoter (pEL) (SEQ ID NO:74) and DNA encoding murine OX40L (SEQ ID NO:22), canine OX40L (SEQ ID NO:23) or human OX40L (SEQ ID NO: 24) under control of the Vaccinia early/late promoter (pEL) (SEQ ID NO:74). The resulting vectors encoding murine, canine or human 4-1BBL and OX40L (loxP→pEL→TurboFP635-→loxP→pEL→4-1BBL→pEL→OX40L) were designated as vectors 13, 14 and 15, respectively. The TurboFP635 cassette can be used as a selection gene and can be excised as needed using loxP/CRE recombinase.

(2) Single Chain Antibody Against VEGF (scAb(VEGF)) and OX40L (Murine-Vector 16, Human-Vector 17)

Donor vectors encoding two therapeutic genes: (a) a single chain antibody against VEGF (scAb(VEGF)) linked to DNA encoding an IgK signal peptide and under the control of Vaccinia virus late promoter (pL; SEQ ID NO:20); and (b) murine or human OX40L under the control of Vaccinia virus early/late promoter (pEL; SEQ ID NO:74) promoter, were constructed.

The donor vectors were constructed by linearizing Vector 1 using SphI restriction enzyme and inserting: (1) DNA encoding a single chain antibody against VEGF (scAb (VEGF); SEQ ID NO:10) linked to DNA encoding an IgK signal peptide (SEQ ID NO:11), which facilitates cellular secretion of the antibody, and DNA encoding a FLAG tag (SEQ ID NO:29), which facilitates detection; and (2) DNA encoding murine OX40L (SEQ ID NO:22) or human OX40L (SEQ ID NO:24). The IgK-scAb(VEGF)-FLAG sequence was codon-optimized for expression in Vaccinia virus (e.g., idtdna.com/CodonOpt) and placed under the control of Vaccinia late promoter (pL; SEQ ID NO:20). The murine or human OX40L gene was placed under the control of Vaccinia early/late promoter (pEL; SEQ ID NO:74). The resulting vectors, encoding scAb(VEGF) and murine or human OX40L were designated as vectors 16 and 17, respectively. The TurboFP635 cassette can be used as a selection gene and can be excised as needed using loxP/CRE recombinase.

(3) Single Chain Antibody Against VEGF (scAb(VEGF)) and 4-1BBL (Murine-Vector 18, Human-Vector 19)

Donor vectors encoding two therapeutic genes: (a) a single chain antibody against VEGF (scAb(VEGF)) linked to DNA encoding an IgK signal peptide and under the control of Vaccinia virus late promoter (pL; SEQ ID NO:20); and (b) murine 4-1BBL or human 4-1BBL under the control of Vaccinia virus early/late (pEL; SEQ ID NO:74) promoter, were constructed.

The donor vectors were constructed by linearizing Vector 1 using SphI restriction enzyme and inserting: (1) DNA encoding a single chain antibody against VEGF (scAb (VEGF); SEQ ID NO:10) linked to DNA encoding an IgK signal peptide (SEQ ID NO:11), which facilitates cellular secretion of the antibody, and DNA encoding a FLAG tag (SEQ ID NO:29), which facilitates detection; and (2) DNA encoding murine 4-1BBL (SEQ ID NO:25) or human 4-1BBL (SEQ ID NO:27). The IgK-scAb(VEGF)-FLAG sequence was codon-optimized for expression in Vaccinia virus (idtdna.com/CodonOpt) and placed under the control of Vaccinia late promoter (pL; SEQ ID NO:20). The murine 4-1BBL or human 4-1BBL gene was placed under the control of Vaccinia early/late promoter (pEL; SEQ ID NO:74). The resulting vectors, encoding scAb(VEGF) and murine or human 4-1BBL were designated as vectors 18 and 19, respectively. The TurboFP635 cassette can be used as a selection gene and can be excised as needed using loxP/CRE recombinase.

(4) Single Chain Antibody Against VEGF (scAb(VEGF)) and hNIS (Vector 20)

A donor vector (vector 20) encoding two therapeutic genes: (a) a single chain antibody against VEGF (scAb (VEGF)) linked to DNA encoding an IgK signal peptide and under the control of Vaccinia virus late promoter (pL; SEQ ID NO:20); and (b) human NIS (hNIS) under the control of Vaccinia virus early/late promoter (pEL; SEQ ID NO:74), was constructed.

The donor vector was constructed by linearizing Vector 1 using SphI restriction enzyme and inserting: (1) DNA encoding a single chain antibody against VEGF (scAb(VEGF); SEQ ID NO:10) linked to DNA encoding an IgK signal peptide (SEQ ID NO:11), which facilitates cellular secretion of the antibody, and DNA encoding a FLAG tag (SEQ ID NO:29), which facilitates detection; and (2) DNA encoding human hNIS (SEQ ID NO:14). The IgK-scAb(VEGF)-FLAG sequence was codon-optimized for expression in Vaccinia virus (idtdna.com/CodonOpt) and placed under the control of Vaccinia virus late promoter (pL; SEQ ID NO:20). The human hNIS gene was placed under the control of Vaccinia virus early/late promoter (pEL; SEQ ID NO:74). The resulting vector (vector 20) containing the loxP→pEL→TurboFP635→1oxP →pL→IgK→scAb (VEGF)→FLAG→PEL→hNIS sequence (upstream→ downstream) was synthesized by Genewiz, Inc. (SEQ ID NO: 38). The sequence of the vector was confirmed by Sanger sequencing (Retrogen, Inc., San Diego, CA). The TurboFP635 cassette can be used as a selection gene and can be excised as needed using loxP/CRE recombinase.

(5) Single Chain Antibody Against VEGF (scAb(VEGF)) and AQP1 (Vector 21)

A donor vector (vector 21) encoding two therapeutic genes: (a) a single chain antibody against VEGF (scAb (VEGF)) linked to DNA encoding an IgK signal peptide and under the control of Vaccinia virus late promoter (pL; SEQ ID NO:20); and (b) human aquaporin 1 (AQP1) under the control of Vaccinia virus early/late promoter (pEL; SEQ ID NO:74), was constructed. Human AQP1 was first amplified from an open reading frame (ORF) cDNA (Origene Technologies, Rockville, MD) (SEQ ID NO:28).

The donor vector (vector 21) was constructed by linearizing Vector 1 using SphI restriction enzyme and inserting: (1) DNA encoding a single chain antibody against VEGF (scAb(VEGF); SEQ ID NO:10) linked to DNA encoding an IgK signal peptide (SEQ ID NO:11), which facilitates cellular secretion of the antibody, and DNA encoding a FLAG tag (SEQ ID NO:29), which facilitates detection; and (2) DNA encoding human AQP1 (SEQ ID NO:28). The IgK-scAb(VEGF)-FLAG sequence was codon-optimized for expression in Vaccinia virus (idtdna.com/CodonOpt) and placed under the control of Vaccinia virus late promoter (pL; SEQ ID NO:20). The human AQP1 gene was placed under the control of Vaccinia virus early/late promoter (pEL; SEQ ID NO:74). The resulting vector (vector 21) containing the loxP→pEL→TurboFP635 →1oxP →pL→IgK→scAb (VEGF)→FLAG→pEL→AQP1 (human) sequence (upstream→downstream) was synthesized by Genewiz, Inc. (SEQ ID NO:39). The sequence of the vector was confirmed by Sanger sequencing (Retrogen, Inc., San Diego, CA). The TurboFP635 cassette can be used as a selection gene and can be excised as needed using loxP/CRE recombinase.

4. Cloning Cas9HFc

The Cas9HF1 plasmid was obtained from Addgene (Cambridge, MA; Plasmid #72247). The Cas9HF cytosolic encoding gene (Cas9HFc) was cloned into pST1374 (Addgene Plasmid ID #13426) without the nuclear localization signal and under the control of a CMV promoter (SEQ ID NO:40) or was synthesized in a plasmid construct by VectorBuilder, Inc., (Shenandoah, TX) under the control of a CMV promoter (SEQ ID NO:40).

5. Recombinant Oncolytic Viruses encoding Therapeutic Genes Transfection and Viral Infection $2\times10^6$ CV-1 cells were seeded in a 6-well plate a day before transfection, to achieve 60-70% confluency. The 60%-70% confluent cells were transfected with 1 μg each of plasmid encoding Cas9HFc and guide RNA (gRNA) using 6 μl of TurboFectin 8.0 transfection reagent (Origene Technologies, Rockville, MD) in 250 ul of opti-DMEM (Thermo Fisher Scientific, Waltham, MA). Twenty-four hours post-transfection, cells were infected with recipient Vaccinia virus (ACAM2000) at an MOI of 0.02 in DMEM high glucose supplemented with 2% FBS. Two hours after virus infection, cells were washed once with PBS. 1.5 $m^1$ DMEM growth medium was added and the cells were placed in a $CO_2$ incubator at 37° C. for 30 minutes before being transfected with 2 μg of a donor plasmid selected from among those described above. The cells were further incubated at 37° C. with 5% $CO_2$ and in a humidified atmosphere for 24 hours. The mixture of infected cells and supernatant was harvested and stored at −80° C. for virus purification and screening.

Virus Purification

The infected cells were thawed and then sonicated on ice at maximum magnitude for 30 seconds, 3× on/off, to release viruses from the cells. Four monolayers of confluent CV-1 cells in 6-well plates were infected with the released viruses at 2 μl of released virus per plate. Two days after infection, 4-5 green plaques (positive, reflecting expression of eGFP) and control negative plaques (not expressing eGFP) were identified under 2× fluorescence microscopy, collected in cryovials containing 200 μl serum-free DMEM, and passed through 2-4 rounds of plaque purification until pure clones were obtained. Insertion of the desired therapeutic gene(s) at the appropriate locus (between ORF_157 and ORF_158) in the recombinant virus was confirmed by PCR and Sanger sequencing, details of which are set forth below.

PCR and Sanger Sequencing

To confirm the insertion of transgenes at the intergenic locus of the recipient viruses, a primer pair was designed to amplify the intergenic region:

```
                                        (SEQ ID NO: 41)
Reverse Primer: 5' GACGAAGAAGCAAGAGATTGTGT 3'

                                        (SEQ ID NO: 42)
Forward Primer: 5' ACCGTTTCCATTACCGCCA 3'.
```

The target sequences (complements) for the two primers are located on HR-left and HR-right, respectively, of the Vaccinia virus. Amplicons from the original virus prior to Cre/Lox recombination can be primers located on HR-left and HR-right. PCR amplicon from the original non-recombinant virus will be 230 bp in length, while the new recombinant virus amplicon will have a size that is equal to the size of the inserted transgene plus an extra 140 bp from the backbone. The sequences of the PCR products from all the purified clones were confirmed by Sanger sequencing (Retrogen, Inc., San Diego, CA).

Example 9

CAVES Increase the Therapeutic Potential of Recombinant Oncolytic Viruses

As shown in Example 7, CAVES potentiate the therapeutic effects of vaccinia virus by protecting the virus against humoral and cell-mediated immunity and by providing for the expression of virus-encoded proteins, e.g., immunomodulatory proteins, before treatment is administered so that the therapeutic effect is immediate rather than subject to a lag due to viral replication/expression of viral genes being initiated in vivo. CAVES, therefore, can be used to deliver therapeutic proteins directly upon administration, using recombinant viruses that encode the therapeutic proteins and express them in the CAVES prior to administration. The virus-encoded therapeutic proteins can exert initial therapeutic effects directly upon administration and do not depend on tumor infection or on viral amplification in the tumor. In addition, the initial therapeutic effect can be exerted independent of the nature of the tumor microenvironment. If the initial expression of the virus-encoded therapeutic proteins occurs in vivo, the extent of expression often depends on the nature of the tumor microenvironment, e.g., access of the protein synthetic machinery to nutrients in the tumor microenvironment. Because CAVES already contain expressed virus-encoded therapeutic proteins (due to incubation of the cell vehicles with the oncolytic viruses for, e.g., 6 or more hours), the therapeutic proteins can be effective at the time of administration in a manner that is independent of protein synthesis in the tumor microenvironment. The therapeutic effect of, e.g., CAVES-24 or CAVES-48 (cell vehicle and oncolytic virus incubated together for 24 hours or 48 hours, respectively) can be more potent compared to MSC loaded with viruses for, e.g., 2 hours, where synthesis of the virus-encoded therapeutic proteins has not begun or is very limited. This example demonstrates that ex vivo generation of CAVES-48 (i.e., cell vehicle and oncolytic virus incubated together for 48h), using an engineered oncolytic virus encoding a therapeutic protein (prepared as described in Example 8), provides for viral amplification and expression of desired virally-encoded therapeutic protein(s). The CAVES-48 can then be cryopreserved, refrigerated for transportation to a treatment site (1-2 days) or administered immediately.

Recombinant Viruses

Recombinant viruses containing the following therapeutic genes: human

OX40L (hOX40L), mouse OX40L (mOX40L), human 4-1BBL (h4-1BBL), mouse 4-1BBL (m4-1BBL) and a single chain antibody against human CTLA-4 (scAb-hCTLA-4) were prepared as described in Example 8. A 92 bp gap between ORF_157 and ORF_158 of CAL-01 was replaced by TurboFP635 as a reporter gene upstream of one of the aforementioned therapeutic genes. The new recombinant viruses based on CAL-01 are referred to in this example with the prefix "CAL-02."

| Virus name | Recombinant immunotherapeutic |
|---|---|
| CAL-02.h1 | hOX40L |
| CAL-02.m1 | mOX40L |
| CAL-02.h2 | h4-1BBL |
| CAL-02.m2 | m4-1BBL |
| CAL-02.h3 | sc-hCTLA4 |

Human adipose-derived MSCs were loaded with one of the recombinant viruses listed above at an MOI of 0.1 in 1 m[1] DMEM supplemented with 2% fetal bovine serum (FBS), 1% antibiotics (equal parts ampicillin and streptomycin) and 2 mM glutamine over a period of 2 hours in a $CO_2$ incubator at 37° C., with continuous rotation at 20 RPM. The cells then were added to a 10 cm round dish filled with 10 m[1] fresh growth media (5% Stemulate® pooled human platelet lysate, 1% antibiotics and 2 mM glutamine). The mixture of virus and cells was further incubated in the $CO_2$ incubator at 37° C. for up to 2 days. The cells were washed with 1×PBS and detached with 1.5 m[1] of TrypLE enzyme (Thermo Fisher Scientific, Waltham, MA) for 6 minutes. All cells then were collected and centrifuged at 500 g for 5 minutes. Cells were washed again with 1×PBS and cryopreserved as described in Examples 6 and 7.

To confirm expression of therapeutic proteins at the cell surface, AD-MSCs that were incubated for 48 hours with the different recombinant viruses were stained using fluorescent-labeled antibodies or isotype controls listed in Table X13. sc-hCTLA4 was fused with a FLAG tag and sc-hCTLA4 was detected using a FLAG tag antibody.

TABLE X13

| Virus name | Recombinant immunotherapeutic | Detection antibody | Isotype control |
|---|---|---|---|
| CAL-02.h1 | hOX40L | BV421 Mouse Anti-Human OX40 Ligand Biolegend Cat. 563766 | BV421 Mouse IgG1, k Isotype Control Biolegend Cat 562438 |
| CAL-02.m1 | mOX40L | Alexa Fluor ® 647 anti-mouse OX40L BioLegend, Cat. 108809 | Alexa Fluor ® 647 Rat IgG2b, κ Isotype, BioLegend, Cat. 400626. |
| CAL-02.h2 | h4-1BBL | Brilliant Violet 421 ™ anti-human CD137L 4-1BB Ligand Antibody Biolegend, Cat. 311507 | Brilliant Violet 421 ™ Mouse IgGl, κ Isotype Ctrl Antibody, Biolegend, Cat. 400157 |
| CAL-02.m2 | m4-1BBL | PE anti-mouse 4-1BB Ligand Biolegend, Cat. 107105 | PE Rat IgG2a, κ Isotype Ctrl, Biolegend, Cat. 400507 |
| CAL-02.h3 | sc-hCTLA4 | APC anti-DYKDDDDK Tag Antibody Biolegend, Cat. 637307 | APC Rat IgG2a, κ Isotype Ctrl Antibody, Biolegend, Cat. 400511 |

After labeling the CAVES-48, cell surface expression of the therapeutic proteins was analyzed in intact cells by flow cytometry. The percentages of positive cells (CAVES-48) are listed in Table X14 below.

TABLE X14

| Virus name | Recombinant immunotherapeutic | % of cells expressing virus-encoded therapeutic protein in cell membrane |
|---|---|---|
| CAL-02.h1 | hOX40L | 86.9 |
| CAL-02.m1 | mOX40L | 85.1 |
| CAL-02.h2 | h4-1BBL | 74.9 |

TABLE X14-continued

| Virus name | Recombinant immunotherapeutic | % of cells expressing virus-encoded therapeutic protein in cell membrane |
|---|---|---|
| CAL-02.m2 | m4-1BBL | 89.1 |
| CAL-02.h3 | sc-hCTLA4 | 13.3 |

The data show that therapeutic protein was present in the cell membrane in the generated CAVES. OX40L and 4-1BBL are cell membrane ligands; therefore, these proteins should be found in the cell membrane at high levels. sc-hCTLA4, however, is expressed as a secreted form, and, therefore, will not be retained at high levels in the cellular membrane. Therefore, a cytosolic detection using a FLAG-tagged antibody was performed to analyze the percentage of cells containing therapeutic sc-hCTLA4 protein. The percent of positively signaling MSCs for sc-hCTLA4 increased up to 87.7% in only 48 hours of incubation with the CAL-02.h3 virus.

The results demonstrate that generation of CAVES-48 permits the expression of virus-encoded therapeutic genes that can have an immediate effect upon administration that is independent of tumor microenvironment, initial anti-viral barriers, or tumor cell permissiveness of viral amplification and virus-encoded protein synthesis.

Example 10

CAVES Increase the Therapeutic Efficacy of Oncolytic Viruses Against Tumors (1) Prostate Cancer The anticancer therapeutic effect of naked CAL1 virus, and MSC/CAL1, were compared to each of CAVES-24 h and CAVES-40 h delivered intratumorally in a xenogeneic (human) prostate tumor model systems. A frozen stock of MSC loaded with VV (2h) or CAVES were generated and stored at −80° C. or in liquid nitrogen, as described in Examples 6 and 7.

CAVES (24 h or 40 h incubation with MSC) show increased therapeutic efficacy compared to naked CAL1 virus or CAL1 virus incubated with MSC for a short period of time (2 h incubation with MSC)

To analyze the therapeutic effect of cryopreserved $1\times10^6$ CAVES (24 h or 48 h incubation) compared to each of MSC/CAL1 (2 h incubation) and naked CAL1 (cryopreserved lot) in the xenogeneic animal model, prostate tumors were generated by injecting 2x106 aggressive metastatic human prostate cancer PC3 cells subcutaneously into the right flank of 4-6 week athymic nude mice. When tumors reached an average volume of 150 $mm^3$ (2 weeks after tumor cells inoculation), the mice were injected intratumorally with one of the following treatments: 1x106 pfu naked CAL1 virus (n=6); or 1x107 pfu naked CAL1 virus (n=5); or 1x106 MSC loaded with CAL1 (MOI=10) for 2h (n=7); or CAVES-24h (prepared with CAL1 MOI=1;n=7); or CAVES-40h (prepared with CAL1 MOI=0.1; n-6) or PBS (n=6). Tumor volumes were measured twice a week for the length of the experiment. For a single intratumoral injection, the data show that a treatment containing MSC was therapeutically more efficient than virus alone; CAVES were the most efficient treatment compared to MSC/CAL1 2 h or naked virus. CAVES-40 h was the most efficient treatment, even though 100 times less virus was used to manufacture the treatment.

| Treatment | MSC Cells injected | Amount of CAL1 virus at time of injection | Amount of CAL1 used to manufacture treatment | Mean Tumor volume fold change relative to day of treatment | Geomean. Tumor volume fold change relative to day of treatment | P (treatment versus Control) |
|---|---|---|---|---|---|---|
| Control (PBS) | — | — | — | 22.5 | 20.8 | — |
| CAL1-1 x 10 ^ 6 | — | 1 x 10 ^ 6 | 1 x 10 ^ 6 | 17.6 | 13.5 | 0.5338 |
| CAL1-1 x 10 ^ 7 | — | 1 x 10 ^ 7 | 1 x 10 ^ 7 | 10.5 | 9.5 | 0.0177 |
| MSC/CAL1-2 h | 1 x 10 ^ 6 | 1 x 10 ^ 6 | 1 x 10 ^ 7 | 8.3 | 7.6 | 0.007 |
| CAVES-24 h | 1 x 10 ^ 6 | 3.2 x 10 ^ 6 | 1 x 10 ^ 6 | 7.1 | 5.7 | 0.0041 |
| CAVES-40 h | 1 x 10 ^ 6 | 4.6 x 10 ^ 6 | 1 x 10 ^ 5 | 5.8 | 3.8 | 0.0082 |

Therapeutic efficacy of CAVES as a function of the amount of Virus used To further analyze the therapeutic efficacy of cryopreserved CAVES as a function of the amount of CAL1 virus added to the cells when making the CAVES, the following three CAVES were prepared:

SNV-1a: $1\times10^7$ pfu CAL1 virus incubated with adipose derived stem cells (MOI 0.1, 38-42 hours)

SNV-1b: $1\times10^6$ pfu CAL1 virus incubated with adipose derived stem cells (MOI 0.1, 38-42 hours)

SNV-1c: $1\times10^5$ pfu CAL1 virus incubated with adipose derived stem cells (MOI 0.1, 38-42 hours)

Incubations were performed in a $CO_2$ incubator at 37 degree Celsius. At the time of harvest, all cells were infected with viabilities greater 60%. The CAVES were cryopreserved with CryoStor10 (or CryoStor5) at a concentration of 10 million cells per m1. Cryopreserved CAVES were tested for PFU/cells using a plaque assay and were selected with a minimum value of about 3-10 pfu/cells, 2000-5000 DNA copies per cell.

Prostate tumors were generated by implanting 2x106 aggressive metastatic human prostate cancer PC3 cells subcutaneously into the right flank of 4-6 week athymic nude mice. When tumors reached an average volume of 150 $mm^3$ (2 weeks after tumor cells inoculation), the mice were injected intratumorally (Day 0) with one of the following treatments (n=8 for all treatments): No treatment (control-PBS) $1\times10^6$ pfu naked CAL1 virus;

$1\times10^7$ pfu naked CAL1 virus;

$1\times10^6$ SNV-la;

$1\times10^6$ SNV-1b;

$1\times10^6$ SNV-1c

Tumor volumes were measured twice a week for the length of the experiment (up to Day 15). For a single intratumoral injection, the data demonstrated that at Day 15, the control showed about a 20-fold increase in tumor volume. By comparison, treatment with $1\times10^6$ pfu naked CAL1 virus resulted in a 12-fold increase in tumor volume at Day 15, and treatment with $1\times10^7$ pfu naked CAL1 virus resulted in a 7.5-fold increase in tumor volume at Day 15. The CAVES showed greater efficacy in slowing tumor progression, with treatment with SNV-la showing about a 6.5-fold increase in tumor volume at Day 15, SNV-1b showing about a 5-fold increase in tumor volume at Day 15 and SNV-1c showing only about a 3.5-4 fold increase in tumor volume at Day 15. Thus, the results further demonstrate that CAVES made using a lower pfu (1×10$^5$ pfu, i.e., SNV-1c) have increased therapeutic potential compared to treatment with CAVES made using higher pfu (1×10$^7$ pfu, i.e., SNV-la and 1×10$^6$ pfu, i.e., SNV-1b). The Tables below show the significantly smaller tumor volume after treatment with CAVES, compared to controls or treatment with naked virus:

Tumor volumes were measured twice a week for the length of the experiment (up to Day 15). For a single intratumoral injection, the data demonstrated that at Day 15, the control showed an average tumor volume of about 1150 mm$^3$. By comparison, treatment with SNV-1c resulted in an average tumor volume of about 500 mm$^3$ at Day 15. In addition, by Day 30 following treatment, the tumor in the SNV-1c treated animals had shrunk to about 250 mm$^3$.

| PC-3 (human prostate cancer model) | | | | | | | | |
|---|---|---|---|---|---|---|---|---|
| | Control (PBS) Tumor volume (mm$^3$) | | CAVEs Tumor volume (mm$^3$) | | CAL1 (1 × 10$^6$) Tumor volume (mm$^3$) | | CAL1 (1 × 10$^7$) Tumor volume (mm$^3$) | |
| Animals | Day 0 | Day 15 | Day 0 | Day 15 | Day 0 | Day 15 | Day 0 | Day 15 |
| 1 | 84.44 | 2112.41 | 87.30 | 357.46 | 47.66 | 145.79 | 65.05 | 809.45 |
| 2 | 65.36 | 2329.47 | 99.66 | 160.13 | 101.87 | 3423.05 | 50.39 | 2141.00 |
| 3 | 109.44 | 2618.42 | 101.80 | 123.55 | 123.81 | 264.48 | 91.12 | 382.20 |
| 4 | 101.48 | 1910.07 | 59.80 | 933.62 | 99.28 | 1898.58 | 150.37 | 1575.24 |
| 5 | 124.98 | 1853.07 | 70.62 | 428.83 | 139.95 | 2459.76 | 212.69 | 3690.96 |
| 6 | 216.49 | 2931.86 | 310.02 | 1730.36 | 147.80 | 3137.03 | 269.12 | 2141.48 |
| 7 | 207.67 | 3024.46 | 182.42 | 820.44 | 152.62 | 1841.06 | | |
| 8 | 322.39 | 2780.37 | 286.47 | 1980.61 | 347.36 | 3756.48 | | |
| Average | 154.03 | 2445.02 | 149.76 | 816.87 | 145.05 | 2115.78 | 139.79 | 1790.05 |
| SD | 87.36 | 459.17 | 98.93 | 704.68 | 88.57 | 1362.40 | 87.29 | 1170.46 |
| GEOMEAN | 135.11 | 2406.38 | 125.26 | 546.54 | 126.47 | 1382.86 | 117.04 | 1421.40 |

Similar results were observed when the CAVES treatment was initiated 13 days following tumor implantation and tumor volume measured 14 days after the initiation of CAVES treatment. The results are shown in the Table below:

| PC-3 (human prostate cancer model) | | | | |
|---|---|---|---|---|
| | Control (PBS) Tumor volume (mm$^3$) | | CAVEs Tumor volume (mm$^3$) | |
| Animals | Day 0 | Day 14 | Day 0 | Day 14 |
| 1 | 138.56 | 1337.31 | 187.06 | 613.08 |
| 2 | 175.08 | 1935.60 | 87.84 | 1014.54 |
| 3 | 77.78 | 2143.84 | 87.22 | 919.97 |
| 4 | 208.09 | 2702.82 | 242.72 | 627.20 |
| 5 | 272.52 | 1854.87 | 210.86 | 891.24 |
| Average | 174.41 | 1994.89 | 163.14 | 813.21 |
| SD | 73.12 | 494.70 | 71.79 | 182.12 |
| GEOMEAN | 160.65 | 1944.80 | 148.96 | 796.15 |

Treatment with CAVES (SNV-1c) induces Tumor Regression in Human Prostate Cancer

In addition to slowing tumor progression, treatment with SNV-1c was found to induce tumor regression. Aggressive metastatic PC3 cells were initiated from a bone metastasis of a grade IV prostatic adenocarcinoma from a 62-year-old male Caucasian. (ATCC® CRL-1435TM). Prostate tumors were generated by injecting 2×106 aggressive metastatic human prostate cancer PC3 cells subcutaneously into the right flank of 4-6 week athymic nude mice. When tumors reached an average volume of 150 mm$^3$ (2 weeks after tumor cells inoculation), the mice were injected intratumorally (Day 0) with one of the following treatments (n=5 per treatment group): No treatment (control-PBS) or 1×10$^6$ SNV-1c.

The results demonstrate that CAVES can treat tumors by shrinking them, in addition to slowing tumor growth.

SNV-1c Injected Intratumorally does not Cause Systemic Viremia

The biodistribution and virus amplification potential of SNV-1c was analyzed, to determine its tumor selectivity and assess whether there were negative effects on normal tissues. The athymic nude mice discussed above were sacrificed 15 days after treatment. 11 tissue samples were harvested per animal (blood, tumor, brain, heart, kidneys (pair), liver, lung, bladder, prostate, testes, spleen) and cryopreserved in liquid nitrogen. Samples were examined by plaque assay as well as real time semiquantitative PCR (qPCR), to detect the presence of viral DNA or infectious particles. The analyses revealed that practically all of the virus was localized to the tumors, with no detectable virus in the non-tumor tissues.

SNV-1c Treatment Inhibits Tumor Progression and Recruits Adaptive Immune Cell Populations in Immunocompetent In Vivo Models of Prostate Cancer The therapeutic efficacy of SNV-1c was tested in two immunocompetent mouse models of prostate cancer: TRAMPC2 (slow growing tumor) and RM1 (fast growing tumor). TRAMP-C2 and cell lines were derived in 1996 from a heterogeneous 32-week primary tumor in the prostate of a PB-Tag C57BL/6 (TRAMP) mouse (ATCC-CRL-2731). RM1 is a Ras+Myc-induced prostate cancer that developed from a urogenital sinus mouse prostate reconstitution (ATCC® CRL-3310TM). Prostate tumors were generated by injecting 2×106 TRAMPC2 or RM1 prostate cancer cells subcutaneously into the right flank of 4-6 week athymic nude mice. For TRAMPC2, tumor cells were implanted subcutaneously on right flank 20 days before CAVES treatment. For RM1, tumor cells were implanted subcutaneously on the right flank 5 days before CAVES treatment. CAVES treatment was initiated by intratumoral injection with 1×10$^6$ SNV-1c every 2 days for 3 times. Control animals were not treated (PBS) (n=5 per treatment group).

The data demonstrated that at Day 27 following the initiation of intratumoral injection into the TRAMPC2 tumor, the control animals showed an average tumor volume of about 500 mm$^3$. By comparison, treatment with SNV-1c showed little to no detectable tumor at Day 27. The results are detailed in the Table below:

TRAMP-C2 (murine prostate tumor model)

| Animals | Control (PBS) Tumor volume (mm$^3$) | | CAVEs Tumor volume (mm$^3$) | |
|---|---|---|---|---|
| | Day 0 | Day 27 | Day 0 | Day 27 |
| 1 | 15.58 | 207.95 | 42.67 | 33.01 |
| 2 | 35.44 | 250.62 | 16.18 | 00.00 |
| 3 | 13.08 | 399.91 | 18.17 | 00.00 |
| 4 | 8.57 | 281.40 | 36.70 | 405.52 |
| 5 | 15.46 | 269.10 | 38.89 | 00.00 |
| Average | 17.63 | 281.80 | 30.52 | 87.71 |
| SD | 10.35 | 71.66 | 12.39 | 178.24 |
| GEOMEAN | 15.71 | 275.19 | 28.22 | 2.00 |

For the fast growing RM1 tumor, the data demonstrated that at Day 7 following intratumoral injection, the control animals showed an average tumor volume of about 2500 mm$^3$. By comparison, treatment with SNV-1c showed resulted in a tumor volume of about 1000 mm$^3$. The results are detailed in the Table below:

RM-1 (murine prostate cancer model)

| Animals | Control (PBS) Tumor volume (mm$^3$) | | CAVEs Tumor volume (mm$^3$) | |
|---|---|---|---|---|
| | Day 0 | Day 7 | Day 0 | Day 7 |
| 1 | 25.63 | 3059.56 | 32.46 | 507.42 |
| 2 | 32.54 | 1183.28 | 36.93 | 1022.94 |
| 3 | 50.87 | 2132.57 | 53.16 | 946.79 |
| 4 | 55.12 | 2268.61 | 57.30 | 1054.09 |
| 5 | 61.01 | 5067.47 | 63.54 | 1644.57 |
| 6 | 70.62 | 2762.41 | 100.23 | 1530.01 |
| 7 | 80.02 | 2156.55 | | |
| Average | 53.69 | 2661.49 | 57.27 | 1117.64 |
| SD | 19.48 | 1213.23 | 24.21 | 415.28 |
| GEOMEAN | 50.23 | 2449.26 | 53.43 | 1045.16 |

In addition, in the RMI tumors, it was found that treatment with SNV-1c increased recruitment of adaptive T cell populations, thereby further increasing the therapeutic efficacy. Treatment with SNV-1c provided a sustained increase in CD8+ cytotoxic T cell populations and some increase in CD4+ populations, as measured in cells/g tumor and as a percentage in live cells. No increase was observed in the NK cell population. The improved frequency of CD8+ T cell populations is associated with improved Total CD8/Treg ratio (about 6 for SNV-1c treated samples, compared to about 2 for control samples) and improved CD4 Teff/Treg ratio (about 1.5 for SNV-1c treated samples, compared to about 0.6 for control samples).

(2) Other Cancer Models

The therapeutic efficacy of SNV-1c was tested and found to be effective in a number of other cancer models.

Murine Colon Cancer Model (CT26)

Colon tumors were generated by injecting 2×106 CT26 cells subcutaneously into the right flank of 4-6 week athymic nude mice. CT26 is an N-nitroso-N-methylurethane-(NNMU) induced, undifferentiated colon carcinoma cell line. It was cloned to generate the cell line designated CT26.WT (ATCC CRL-2638). 7 days after injection of the tumor cells, the mice were injected intratumorally every two days for 3 times with 1×10$^6$ SNV-1c, 1×10$^7$ naked CAL1 virus, or left untreated (intratumoral injection of PBS) (n=8 per treatment group).

The data demonstrated that at Day 15 following initiation of intratumoral injections into the CT26 tumor, the control animals showed an average tumor volume of between 1250-1500 mm$^3$. By comparison, treatment with naked virus resulted in an average tumor volume of about 1000 mm$^3$ at Day 15. Treatment with SNV-1c resulted in a significant slowing of tumor progression, with an average tumor volume of about 200 mm$^3$ at Day 15.

In addition, it was found that SNV-1c slowed the tumor progression of a distant, untreated tumor formed by introduction of CT26 tumor cells into the left flank of the mice (intratumoral injection of SNV-1c was into the tumors in the right flank). Upon treatment with a intratumoral injections of SNV-1c, not only was the average tumor volume in the right flank about 200 mm$^3$ at Day 15 (as discussed above, relative to the control of 1250-1500 mm$^3$), the average tumor volume in the uninjected left flank also was only about 500 mm$^3$ relative to the control value of 1250-1500 mm$^3$. The results show that treatment with an exemplary CAVES, SNV-1c, is efficacious against both directly (proximally) treated and distant tumors. The results are detailed in the Table below:

CT-26 (murine colon tumor model)-Treated tumor

| Animals | Control (PBS) Tumor volume (mm$^3$) | | CAVEs (1 × 10$^6$) Tumor volume (mm$^3$) | | CAL1 (1 × 10$^7$) Tumor volume (mm$^3$) | |
|---|---|---|---|---|---|---|
| | Day 0 | Day 15 | Day 0 | Day 15 | Day 0 | Day 15 |
| 1 | 31.30 | 1216.31 | 31.99 | 635.79 | 32.43 | 1840.97 |
| 2 | 32.77 | 941.66 | 36.66 | 1120.45 | 36.70 | 781.61 |
| 3 | 40.15 | 1964.12 | 37.65 | 1089.86 | 38.57 | 508.94 |
| 4 | 43.44 | 1482.10 | 40.21 | 922.97 | 41.27 | 662.43 |
| 5 | 50.05 | 855.60 | 52.97 | 476.89 | 43.91 | 1153.14 |
| 6 | 56.19 | 2022.72 | 58.42 | 101.59 | 60.92 | 2668.40 |
| 7 | 63.35 | 1610.02 | 90.37 | 536.00 | 95.09 | 2112.14 |
| Average | 45.32 | 1441.79 | 49.75 | 697.65 | 49.84 | 1389.66 |
| SD | 11.90 | 462.75 | 20.25 | 369.08 | 21.91 | 825.73 |
| GEOMEAN | 43.99 | 1374.96 | 46.87 | 566.00 | 46.67 | 1178.27 |

CT-26 (murine colon tumor model)-Untreated tumors

| Animals | Control (PBS) Tumor volume (mm$^3$) | | CAVEs (1 × 10$^6$) Tumor volume (mm$^3$) | | CAL1 (1 × 10$^7$) Tumor volume (mm$^3$) | |
|---|---|---|---|---|---|---|
| | Day 0 | Day 15 | Day 0 | Day 15 | Day 0 | Day 15 |
| 1 | 42.57 | 1415.86 | 31.99 | 101.51 | 17.17 | 749.49 |
| 2 | 100.07 | 989.04 | 38.54 | 1178.08 | 22.48 | 1119.62 |
| 3 | 138.18 | 2020.00 | 92.13 | 1821.97 | 91.09 | 3105.99 |
| 4 | 63.50 | 1221.24 | 10.26 | 2547.50 | 14.18 | 619.53 |
| 5 | 14.70 | 1858.25 | 41.27 | 832.98 | 63.24 | 1587.05 |
| 6 | 39.75 | 1219.00 | 53.18 | 354.10 | 54.84 | 1710.45 |
| 7 | 75.60 | 1505.47 | 11.67 | 677.90 | 66.04 | 3132.95 |
| Average | 67.77 | 1461.27 | 39.86 | 1073.43 | 47.00 | 1717.87 |
| SD | 41.47 | 368.13 | 27.83 | 858.34 | 29.44 | 1036.70 |
| GEOMEAN | 55.64 | 1422.41 | 31.37 | 730.48 | 37.99 | 1453.90 |

Similar results were observed when the CAVES treatment was initiated 13 days following tumor implantation and tumor volume measured 20 days after the initiation of CAVES treatment. The results are shown in the Table below:

| CT-26 (murine colon tumor model) | | | | |
|---|---|---|---|---|
| | Control (PBS) Tumor volume (mm$^3$) | | CAVEs Tumor volume (mm$^3$) | |
| Animals | Day 0 | Day 20 | Day 0 | Day 20 |
| 1 | 147.08 | 1830.62 | 351.05 | 2917.04 |
| 2 | 97.11 | 3765.42 | 266.56 | 872.34 |
| 3 | 378.80 | 2487.15 | 134.08 | 895.69 |
| 4 | 186.68 | 3181.70 | 32.00 | 412.78 |
| 5 | 85.62 | 3309.53 | 99.96 | 886.31 |
| Average | 179.06 | 2914.88 | 176.73 | 1196.83 |
| SD | 118.77 | 759.76 | 129.53 | 983.14 |
| GEOMEAN | 153.95 | 2826.88 | 132.04 | 964.31 |

Murine Melanoma Model

Melanoma tumors were generated by injecting 2×106 B16-F10 cells (melanoma mouse tumor model ATCC® CRL-6475TM) subcutaneously into the right and left flanks of 4-6 week athymic nude mice. 8 days after injection of the tumor cells, the mice were injected intratumorally every 2 days for 3 times in the right flank with $1\times10^6$ SNV-1c or $1\times10^7$ naked CAL1 virus (n=8 per treatment group).

The data demonstrated that at Day 11 following intratumoral injection into the B16 tumor, the naked virus treated animals showed an average right flank tumor volume of about 1400 mm$^3$. Treatment with SNV-1c resulted in a significant slowing of tumor progression, with an average tumor volume of about 600 mm$^3$ at Day 11.

The results are detailed in the Table below:

| B16-F10 (murine melanoma tumor model) | | | | |
|---|---|---|---|---|
| | Control (PBS) Tumor volume (mm$^3$) | | CAVES Tumor volume (mm$^3$) | |
| Animals | Day 0 | Day 11 | Day 0 | Day 11 |
| 1 | 47.91 | 2940.90 | 51.91 | 274.39 |
| 2 | 65.19 | 2543.56 | 64.10 | 542.82 |
| 3 | 40.53 | 2529.39 | 96.36 | 945.26 |
| 4 | 53.65 | 1952.23 | 99.86 | 1539.62 |
| 5 | 73.75 | 4075.98 | 46.72 | 185.92 |
| 6 | 100.44 | 4307.44 | 90.54 | 1498.80 |
| 7 | 96.70 | 4356.06 | 42.21 | 877.31 |
| 8 | 63.18 | 3702.92 | 60.85 | 1023.77 |
| Average | 67.67 | 3301.06 | 69.07 | 860.99 |
| SD | 21.73 | 926.30 | 23.18 | 507.41 |
| GEOMEAN | 64.71 | 3180.13 | 65.72 | 694.71 |

It was found that SNV-1c slowed the tumor progression of the distant, untreated tumor formed by introduction of B16-F10 melanoma cells into the left flank of the mice (intratumoral injection of SNV-1c was into the tumors in the right flank). Upon treatment with a single intratumoral injection of SNV-1c, not only was the average tumor volume in the right flank about 600 mm$^3$ at Day 11, the average tumor volume in the uninjected left flank also was only about 700 mm$^3$ relative to the control (naked virus treatment) value of about 1600 mm$^3$. The results show that SNV-1c is efficacious against both directly (proximally) treated and distant tumors, and is more efficacious at both compared to treatment with the naked virus.

When a CAL2 recombinant virus encoding a single chain antibody against VEGF was used to prepare the CAVES (SNV-2c, made by incubating adipose derived stem cells with $1\times10^5$ pfu CAL2 virus instead of CAL1 virus) was used, the therapeutic efficacy of the SNV-2c CAVES were found to be more enhanced than the SNV-1c, as shown by an even greater inhibition of tumor progression. The results are shown in the Table below:

| B16-F10 (murine melanoma tumor model) | | | | | | |
|---|---|---|---|---|---|---|
| | Control (PBS) Tumor volume (mm$^3$) | | SNV-1c Tumor volume (mm$^3$) | | SNV-2c (anti-VEGF) Tumor volume (mm$^3$) | |
| Animals | Day 0 | Day 11 | Day 0 | Day 11 | Day 0 | Day 11 |
| 1 | 47.91 | 2940.90 | 51.91 | 274.39 | 51.74 | 180.73 |
| 2 | 65.19 | 2543.56 | 64.10 | 542.82 | 32.41 | 230.96 |
| 3 | 40.53 | 2529.39 | 96.36 | 945.26 | 56.72 | 258.88 |
| 4 | 53.65 | 1952.23 | 99.86 | 1539.62 | 36.73 | 126.17 |
| 5 | 73.75 | 4075.98 | 46.72 | 185.92 | | |
| 6 | 100.44 | 4307.44 | 90.54 | 1498.80 | | |
| 7 | 96.70 | 4356.06 | 42.21 | 877.31 | | |
| 8 | 63.18 | 3702.92 | 60.85 | 1023.77 | | |
| Average | 67.67 | 3301.06 | 69.07 | 860.99 | 44.40 | 199.19 |
| SD | 21.73 | 926.30 | 23.18 | 507.41 | 11.67 | 58.44 |
| GEOMEAN | 64.71 | 3180.13 | 65.72 | 694.71 | 43.23 | 192.16 |

Breast Cancer Models

The therapeutic efficacy of SNV-1c was tested in two models of breast cancer: a murine breast cancer model (EMT-6) and a human triple negative breast cancer model (MDA-MB-231). EMT6 was established from a transplantable murine mammary carcinoma that arose in a BALB/cCRGL mouse after implantation of a hyperplastic mammary alveolar nodule. The resulting tumor line (named KHJJ) was propagated in BALB/cKa mice and adapted to tissue culture after the 25th animal passage, and the cell line was named EMT. EMT6 is a clonal isolate of EMT isolated in 1971 at Stanford University (ATCC® CRL-2755TM). The MDA-MB-231 cell line is a highly aggressive, invasive and poorly differentiated triple negative breast cancer cell line lacking oestrogen receptor and progesterone receptor expression, as well as HER2 amplification; it was established from a pleural effusion of a 51-year old Caucasian female with a metastatic mammary adenocarcinoma.

Tumors were generated by injecting $2\times10^6$ EMT-6 breast cancer cells subcutaneously on the right and left flanks of 4-6 week athymic nude mice, 4 days before CAVEs treatment. $1\times10^6$ SNV-1c were then injected intratumorally every 2 days for 3 times in the right flank only. For the MDA-MB-231 triple negative breast cancer, cells were implanted subcutaneously on the right and left flanks 27 days before CAVEs treatment. $1\times10^6$ SNV-1c were then injected intratumorally once in the right flank only. Controls included intratumoral injection with $1\times10^7$ naked CAL1 virus or PBS (n=8 per treatment group).

The data for the EMT-6 breast cancer model demonstrated that at Day 14 following intratumoral injection into the tumor, control (PBS-treated) animals showed an average right flank tumor volume of about 950 mm$^3$. Treatment with SNV-1c resulted in a significant slowing of tumor progression, with an average tumor volume of about 350 mm$^3$ at Day 14. The results on Day 18 are provided in detail in the Table below:

| EMT-6 (murine breast tumor model) | | | | |
|---|---|---|---|---|
| | Control (PBS) Tumor volume (mm$^3$) | | CAVES Tumor volume (mm$^3$) | |
| Animals | Day 0 | Day 18 | Day 0 | Day 18 |
| 1 | 36.03 | 1248.91 | 46.08 | 706.24 |
| 2 | 33.01 | 1375.55 | 55.21 | 272.84 |

-continued

| EMT-6 (murine breast tumor model) | | | | |
|---|---|---|---|---|
| | Control (PBS) Tumor volume (mm$^3$) | | CAVES Tumor volume (mm$^3$) | |
| Animals | Day 0 | Day 18 | Day 0 | Day 18 |
| 3 | 49.86 | 1643.58 | 40.36 | 235.31 |
| 4 | 46.16 | 2214.44 | 48.93 | 1550.42 |
| 5 | 70.39 | 2125.76 | 69.73 | 1768.94 |
| 6 | 34.37 | 1776.69 | 33.05 | 856.59 |
| 7 | 66.20 | 1562.32 | 63.18 | 96.92 |
| 8 | 49.50 | 2267.86 | 30.51 | 741.28 |
| 9 | | | 73.65 | 483.30 |
| Average | 48.19 | 1776.89 | 51.19 | 745.76 |
| SD | 14.12 | 388.75 | 15.46 | 579.04 |
| GEOMEAN | 46.46 | 1739.09 | 49.05 | 536.76 |

In addition, it was found that SNV-1c slowed the tumor progression of the distant, untreated tumor formed by introduction of breast tumor cells into the left flank of the mice (intratumoral injection of SNV-1c was into the tumors in the right flank). Upon treatment with a single intratumoral injection of SNV-1c, not only was the average tumor volume in the right flank about 350 mm$^3$ at Day 14, the average tumor volume in the uninjected left flank also was only about 450 mm$^3$ relative to the control (naked virus treatment) value of about 950 mm$^3$. The results show that SNV-1c is efficacious against both directly (proximally) treated and distant tumors, and is more efficacious at both compared to treatment with the naked virus.

Similarly, for the triple negative breast cancer model (MDA-MB-231), for a single intratumoral injection, the data for the breast cancer model demonstrated that at Day 14 following intratumoral injection into the tumor, the naked virus treated animals showed an average right flank tumor volume of about 950 mm$^3$. Treatment with SNV-1c resulted in a significant slowing of tumor progression, with an average tumor volume of about 350 mm$^3$ at Day 14. The results on Day 46 are detailed in the Table below:

| MDA-MB-231 (human breast tumor model) | | | | |
|---|---|---|---|---|
| | Control (PBS) Tumor volume (mm$^3$) | | CAVEs Tumor volume (mm$^3$) | |
| Animals | Day 0 | Day 46 | Day 0 | Day 46 |
| 1 | 50.08 | 2488.98 | 76.43 | 45.88 |
| 2 | 117.65 | 2411.28 | 69.86 | 336.12 |
| 3 | 66.26 | 2718.91 | 59.20 | 38.41 |
| 4 | 10.96 | 1176.76 | 10.49 | 0.00 |
| 5 | | | 30.01 | 2794.74 |
| Average | 61.24 | 2198.98 | 49.20 | 643.03 |
| SD | 44.20 | 693.88 | 28.00 | 1210.34 |
| GEOMEAN | 45.48 | 2093.33 | 39.77 | 44.03 |

It was found that SNV-1c slowed the tumor progression of the distant, untreated tumor formed by introduction of breast tumor cells into the left flank of the mice (intratumoral injection of SNV-1c was into the tumors in the right flank). Upon treatment with a single intratumoral injection of SNV-1c, not only was the average tumor volume in the right flank about 350 mm$^3$ at Day 14, the average tumor volume in the uninjected left flank also was only about 150 mm$^3$ relative to the control (naked virus treatment) value of about 375 mm$^3$. The results show that SNV-1c is efficacious against both directly (proximally) treated and distant tumors in the triple negative breast cancer model.

The results demonstrate that incubation of oncolytic viruses with stem cells, such as MSC, for a time sufficient for immunomodulatory proteins to be expressed significantly improves the therapeutic effect of the oncolytic virus. This improvement is significant compared to virus alone, and virus incubated with cells for substantially less time (2-4 hours, or a time in which immunomodulatory proteins encoded by the virus have not been expressed).

Local administration of CAVEs induces local and distant tumor immune infiltration and efficiently inhibits breast cancer tumor progression of local treated and distant untreated tumors (abscopal effect) in a syngeneic tumor model.

To analyze whether CAVES induces both a local therapeutic effect and asystemic therapeutic effect after local administration, the therapeutic effect of treatment in bilateral tumor mouse models was studied. Balb/c mice were inoculated with EMT6 breast cancer tumor cells in both flanks and when tumors reached the size of 50 mm$^3$, mice were randomized and received a total of 3 treatments with 3 million CAVES, administered directly into the right tumor every other day. The left tumor was untreated. CAVES were generated by infecting stem cells with CAL1 virus at an MOI of 0.1, and harvested at 28 h post infection. The data provided in the Tables below (Right Tumor underwent local treatment; Left Tumor was untreated) show that treatment with CAVES induced significant local as well as systemic therapeutic effects (abscopal effects), as shown by the slowed tumor progression at Day 20 relative to the control animals in both the right and left tumors.

| RIGHT TUMOR - Treated | | | | |
|---|---|---|---|---|
| | Control (PBS) Tumor volume (mm$^3$) | | CAVES Tumor volume (mm$^3$) | |
| Animals | Day 0 | Day 20 | Day 0 | Day 20 |
| 1 | 58.16 | 1733.59 | 58.78 | 1019.08 |
| 2 | 63.08 | 2069.71 | 95.72 | 852.56 |
| 3 | 88.04 | 3286.84 | 33.56 | 1568.85 |
| 4 | 95.79 | 2510.95 | 76.71 | 1668.34 |
| 5 | 54.82 | 2804.48 | 67.35 | 1587.06 |
| 6 | 43.62 | 604.12 | 38.85 | 1659.74 |
| 7 | 67.28 | 2681.67 | 45.58 | 800.01 |
| 8 | 42.53 | 2710.25 | 64.84 | 1471.08 |
| 9 | 32.81 | 2257.16 | 49.73 | 1521.77 |
| Average | 60.68 | 2295.42 | 59.01 | 1349.83 |
| SD | 20.82 | 777.68 | 19.64 | 354.43 |
| GEOMEAN | 57.57 | 2108.32 | 56.17 | 1301.67 |

| LEFT TUMOR -UNTREATED | | | | |
|---|---|---|---|---|
| | Control (PBS) Tumor volume (mm$^3$) | | CAVES Tumor volume (mm$^3$) | |
| Animals | Day 0 | Day 20 | Day 0 | Day 20 |
| 1 | 75.00 | 2293.07 | 57.83 | 2677.34 |
| 2 | 53.28 | 1527.42 | 89.05 | 2387.99 |
| 3 | 39.64 | 2768.27 | 31.66 | 2235.94 |
| 4 | 71.05 | 1626.94 | 45.55 | 1447.40 |
| 5 | 88.29 | 4369.24 | 35.41 | 592.13 |
| 6 | 59.38 | 2664.20 | 30.17 | 1124.84 |
| 7 | 81.33 | 1123.69 | 55.74 | 2501.44 |
| 8 | 45.07 | 2672.30 | 64.36 | 1598.37 |
| 9 | 42.10 | 2105.68 | 52.41 | 1434.36 |
| Average | 61.68 | 2350.09 | 51.35 | 1777.76 |
| SD | 17.96 | 950.07 | 18.63 | 707.68 |
| GEOMEAN | 59.33 | 2190.48 | 48.53 | 1625.06 |

Immune infiltration in both treated (right) and distant untreated (left) tumors was then analyzed. Five days after the treatment, the tumors of 5 control animals and 5 treated animals were excised and enzymatically digested to isolate TILs (Tumor-infiltrating lymphocytes). The TILs were further subjected to surface immunophenotyping and subsequent intracellular Foxp3 stain. Multiparameter flow cytometry analysis was performed to evaluate the immune cell infiltrates in control and treated tumors as well as to investigate the mechanistic basis for the therapeutic abscopal effects observed on untreated distant tumors. Following doublet discrimination and gating out the dead cells, the tumor infiltrating population of CD45+CD11b-low/med TILs was further subdivided into CD3-NKp46+NK cells, CD3+NKp46+NKT cells and CD3+NKp46-T cells. The T cells were further separated into single positive CD4+ or CD8+ T cells, and the CD4+ T cell compartment was additionally analyzed based on the expression of CD25 and Foxp3 to quantitate the CD25+Foxp3-CD4+Teff and CD25+ Foxp3+Tregs, respectively.

As shown in the Table below, flow cytometry analysis demonstrated statistically significant treatment-related proportional increases in the fractions of total infiltrating CD4 and CD8 T cells, and decreases in the fractions of CD4+ CD25+Foxp3+Tregs. The changes in the T cell compartment were further associated with improved ratios of CD25+ Foxp3-CD4+Teff to Tregs and CD8 T cells to Tregs. These changes in the TME (tumor microenvironment) are consistent with conditions favoring oncolysis, resulting in the potentiation of adaptive anti-tumor immunity. Moreover, similar favorable changes in the fractions or ratios of immune infiltrates were observed in both the treated (Right) and distant untreated (Left) tumors, providing a mechanistic basis for the observed potent abscopal effects.

| | | CD4 (% relative to TILS) | CD8 (% relative to TILS) | Treg (% relative to CD4 T cells) | CD4 Teffs/ Tregs | CD8/ Tregs |
|---|---|---|---|---|---|---|
| Untreated-group | Right control | 11.7 | 8.2 | 40.7 | 0.5 | 2.2 |
| | Left control | 11.5 | 7.6 | 38.0 | 0.5 | 2.0 |
| Treated (CAVES)-group | Right Treated Tumor | 21.3 | 15.2 | 15.8 | 1.5 | 4.8 |
| | Left untreated Tumor | 17.1 | 16.6 | 16.1 | 0.9 | 6.3 |

Example 11

Alternate Method of Engineering Recombinant Oncolytic Viruses with Increased Therapeutic Potential Example 8 describes using the CRISPR/Cas9HFc (high fidelity Cas9) system to generate recombinant vaccinia viruses (VACV) encoding therapeutic genes. Alternately, the Cre-Lox method can be used to generate recombinant viruses.

A recipient VACV containing two incompatible Lox sequences, loxM3 (SEQ ID NO: 49) and loxM7 (SEQ ID NO:51), was constructed. The incompatible Lox sequences were introduced into the intergenic locus, between ORF_157 and ORF_158, of the CAL1 genome, using the CRISPR/Cytosolic Cas9HF method. Because introduction of the Lox sequences is in an intergenic locus, the resulting recipient VACV, as well as the ultimate product recombinant virus encoding a therapeutic gene of interest, have all their ORFs intact and retain their original therapeutic potential.

Insertion of the desired therapeutic genes into the recipient VACV was performed by a cytosolic recombination-mediated cassette exchange method (RMCE), which requires the use of: (i) a donor plasmid/vector containing the therapeutic gene of interest and the same two incompatible Lox sequences present in the recipient VACV; and (ii) a vector for the expression of cytosolic CRE (Cre recombinase enzyme). Selection of the desired recombinant virus was achieved by introducing a selection gene in the recipient VACV (the resulting recombinant virus is selected based on the presence of the selection gene in the recombinant virus).

Construction of Donor Vectors to Generate Recipient and Recombinant VACV

Homologous regions (HRs) to the right and left of the intergenic locus between ORF_157 and ORF_158 were selected based on the ACAM2000 Vaccinia virus genome sequence (GenBank Accession No: AY313847; SEQ ID NO:70). The intergenic locus between ORF_157 and ORF_158 is a 271 bp sequence (SEQ ID NO: 3), while the two HRs are a 555 bp sequence to the right (SEQ ID NO:4) and a 642 bp sequence to the left (SEQ ID NO:5) of the intergenic locus. Within the intergenic locus is a 92 bp sequence (SEQ ID NO:6) that is replaced by the therapeutic gene of interest. Two guide RNAs, gRNA1 (SEQ ID NO:1) and gRNA2 (SEQ ID NO:43) were selected to specifically bind to target DNA within the 92 bp intergenic area, using online software (dna20.com/eCommerce/cas9/input). The guide RNAs were introduced into separate vectors (SEQ ID NOs: 2 and 48, for gRNA1 and gRNA2, respectively). Each guide RNA was constructed under the control of a U6 promoter in a lentiviral vector (lentivector). Antibiotic resistance to puromycin was included in each lentivector backbone (vector obtained from VectorBuilder, Inc., Shenandoah, TX).

Donor Vector for First Generation Recipient VACV (Vector 22)

To construct the donor vector for the first generation recipient VACV, the following DNA fragments were synthesized (Genewiz, Inc., San Diego, CA): (a) (upstream) HR (left)→loxM3 (SEQ ID NO:49) (downstream);

(b) DNA encoding enhanced green fluorescent protein (eGFP) flanked by VACV early/late promoter (pEL) upstream and Vaccinia transcription termination signals downstream (SEQ ID NO:50); and (c) (upstream) loxM7 (SEQ ID NO:51)→HR (right) (downstream).

The fragments were cloned in the order (a)→ (b)→ (c) (upstream→downstream) into a pUC18 vector (SEQ ID NO:72) using an in-fusion cloning kit (Takara Bio USA, Inc., Mountain View, CA). Multiple cloning sites were added at both ends of each HR to allow future insertion of a therapeutic gene. The restriction enzyme sites SpeI, XmaI, SmaI, NheI and BmtI were added immediately following the loxM3 sequence and the restriction enzyme sites SphI, MscI, NotI, AgeI, SwaI, and AflII were added immediately preceding the loxM7 sequence. The sequence of the resulting vector (vector 22; loxM3-→pEL→eGFP→loxM7) is set forth as (SEQ ID NO: 44).

Donor Vector for Recipient VACV Encoding the TurboFP635 Fluorescent Protein (Vector 2)

DNA encoding TurboFP635 fluorescent protein under the control of VACV early/late promoter (pEL) and flanked by loxM3 (upstream) and loxM7 (downstream) sequences was introduced into a pUC18 plasmid (SEQ ID NO:72) by VectorBuilder, Inc. (Shenandoah, TX). The sequence of the resulting vector (vector 2), pUC-loxM3-pEL-TurboFP635-loxM7, is set forth as (SEQ ID NO:45).

Vectors Encoding Cytosolic CRE Recombinase

DNA encoding cytosolic Cre recombinase (CRE) from Bacteriophage P1 that was mammalian codon-optimized and under control of the CMV promoter was inserted into a lentiviral vector by VectorBuilder, Inc. (Shenandoah, TX) (Vector 23; SEQ ID NO:46). To prepare a recipient VACV encoding cytosolic Cre recombinase, a donor vector was constructed by inserting, into a pUC18 plasmid (SEQ ID NO:72), DNA encoding eGFP under the control of Vaccinia virus early/late promoter (pEL) and DNA encoding mammalian codon-optimized cytosolic Cre recombinase from Bacteriophage P1 under the control of Vaccinia virus early/late promoter (pEL). A loxM3 sequence was inserted upstream of the eGFP expression cassette and a loxM7 sequence was inserted downstream of the Cre recombinase expression casette. The resulting vector (vector 24) containing the loxM3-→pEL→eGFP→pEL→CRE→loxM7 (upstream→downstream) insert in pUC18 was synthesized by VectorBuilder, Inc. (Vector 24; SEQ ID NO:47).

(1) First Generation Recipient Vaccinia Virus (R1-VACV)

To obtain the first generation of recipient Vaccinia virus, 2×106 CV-1 cells were seeded in a 6-well plate a day before transfection. 60-80% confluent CV-1 cells were transfected with 1 μg of Cas9HFc (cytosolic High Fidelity Cas9) plasmid and 1 μg of guide RNA1, using 6 μl of Turbofectin 8.0 transfection reagent (Origene Technologies, Rockville, MD). The Cas9HF1 plasmid was obtained from Addgene (Cambridge, MA; Plasmid #72247). The Cas9HF cytosolic encoding gene (Cas9HFc) was cloned into pST1374 (Addgene Plasmid ID #13426) without the nuclear localization signal and under the control of a CMV promoter (SEQ ID NO:40), or was synthesized in a plasmid construct by VectorBuilder, Inc., (Shenandoah, TX) under the control of a CMV promoter (SEQ ID NO:40). To minimize the off-target effects, high fidelity Cas9 protein was used with some modifications (*Mali*, et al. (2013) Nat Methods 10 (10): 957-963). Because the entire VACV life cycle occurs in the cytoplasm, the nuclear localization signal (NLS) of high fidelity Cas9 protein was removed, resulting in cytosolic high fidelity Cas9 (Cas9HFc) under the control of a CMV promoter. A day after Cas9HFc and gRNA transfection, cells were infected with WTI (CAL1) virus at an MOI of 0.02 in DMEM high glucose supplemented with 2% FBS. Two hours after virus infection, cells were washed once with PBS and then transfected with 2 μg of donor vector (vector 22). Cells were incubated at 37° C. with 5% $CO_2$ and in a humidified atmosphere for 24 hours. The mixture of infected cells and supernatant was harvested and stored at -80° C. for virus purification.

For virus purification, the infected cells were thawed and then sonicated on ice at maximum magnitude for 30 seconds, 3× on/off, to release viruses from the cells. Four monolayers of confluent CV-1 cells in 6-well plates were infected with the released viruses at 2 μl of released virus per plate. Two days after infection, 4-5 green plaques (positive, reflecting expression of eGFP) and control negative plaques (not expressing eGFP) were identified under 2× fluorescence microscopy, collected in cryovials containing 200 μl serum-free DMEM, and passed through 2-4 rounds of plaque purification until pure clones were obtained. Insertion of the loxM3-→pEL→eGFP→loxM7 sequence in the recipient VACV (WT1 or CAL1) by replacing 92 base pairs of the intergenic region between ORF_157 and ORF 158 was confirmed by PCR and Sanger sequencing, details of which are set forth below.

(2) Generation of Recombinant Viruses Encoding Therapeutic Genes The concept of using the Cre/lox system to generate recombinant Vaccinia virus expressing a gene/genes of interest was tested using a donor plasmid encoding the red fluorescent protein, TurboFP635 (Vector 2, described above). 60-80% confluent CV-1 cells were transfected with 1 μg of plasmid encoding Cre recombinase (Vector 23). 24 hours later, the cells were infected with recipient virus R1-VACV (described above), at an MOI of 0.02. Two hours after infection, the cells were washed with PBS and transfected with 2 μg of Vector 2. In the presence of cytosolic CRE recombinase protein, RMCE occurred between the corresponding loxM3 and loxM7 sequences of R1-VACV and Vector 2. The recombinant mixture was collected 24 hours post virus infection and stored at -80° C. for virus purification.

For virus purification, the infected cells were thawed and then sonicated on ice at maximum magnitude for 30 seconds, 3× on/off, to release viruses from the cells. Four monolayers of confluent CV-1 cells in 6-well plates were infected with the released viruses at 2 μl of released virus per plate. Two days after infection, red plaques (positive, reflecting expression of TurboFP635) were identified and selected (green plaques indicate viruses that are not transformed and still express the eGFP protein) under fluorescence microscopy at 48 hpi. After one freeze-thaw cycle, the lysate was added to a monolayer of CV-1 in a 6-well plate for a second round of plaque purification. Plaque purification was repeated for 2-4 rounds, until pure clones were obtained. The new recombinant VACV (R1-VACV2) can serve as another recipient virus, one that expresses TurboFP635 fluorescent protein instead of eGFP. The efficiency of recombinant vaccinia virus generation using CRME was equivalent to or higher than that of the CRISPR/Cas9 method.

Insertion of the loxM3-→pEL→TurboFP635-→1oxM7 (upstream to downstream) sequence in the recipient VACV (WT1 or CAL1) by replacing 92 base pairs of the intergenic region between ORF_157 and ORF_158 was confirmed by PCR and Sanger sequencing, details of which are set forth below. This method was used to obtain recombinant Vaccinia viruses expressing a variety of therapeutic proteins by replacing Vector 2 with one of the Vectors selected from among Vectors 5-21, described above. Tables X15 and X16 below summarize exemplary vectors for generating the viruses and CAVES provided herein:

TABLE X15

| Vector # | SEQ ID NO. | Description | Vector Construction |
|---|---|---|---|
| 1 | 9 | Vector expressing TurboFP635 (pIg-loxP-TurboFP635) | loxP-pEL-TurboFP635-loxP |
| 2 | 45 | Vector expressing TurboFP635 fluorescent protein | loxM3-pEL-TurboFP635-loxM7 |

TABLE X15-continued

| Vector # | SEQ ID NO. | Description | Vector Construction |
|---|---|---|---|
| 3 | 12 | Vector expressing single chain antibody against VEGF (scAb(VEGF)) and TurboFP635 | LoxP-pEL-TurboFP635-loxP-pL-IgK-scAb(VEGF)-FLAG |
| 4 | 13 | Vector expressing human sodium iodide symporter (hNIS) and TurboFP635 | loxP-pEL-TurboFP635-loxP-pE-hNIS |
| 5 | 30 | Vector expressing single chain antibody against human CTLA-4 (h-scAb (CTLA-4)) and TurboFP635 | LoxP-pEL-TurboFP635-loxP-pEL-IgK-h-scAb(CTLA-4)-FLAG |
| 6 | 31 | Vector expressing single chain antibody against murine CTLA-4 (m-scAb(CTLA-4)) and TurboFP635 | LoxP-pEL-TurboFP635-loxP-pEL-IgK-m-scAb(CTLA-4)-FLAG |
| 7 | 32 | Vector expressing murine OX40L and TurboFP635 | loxP-pEL-TurboFP635-loxP-pEL-murine OX40L |
| 8 | 33 | Vector expressing canine OX40L and TurboFP635 | loxP-pEL-TurboFP635-loxP-pEL-canine OX40L |
| 9 | 34 | Vector expressing human OX40L and TurboFP635 | loxP-pEL-TurboFP635-loxP-pEL human OX40L |
| 10 | 35 | Vector expressing mouse 4-1BBL and TurboFP635 | loxP-pEL-TurboFP635-loxP-pEL-murine 4-1BBL |
| 11 | 36 | Vector expressing canine 4-1BBL and TurboFP635 | loxP-pEL-TurboFP635-loxP-pEL-canine 4-1BBL |
| 12 | 37 | Vector expressing human 4-1BBL and TurboFP635 | loxP-pEL-TurboFP635-loxP-pEL human 4-1BBL |
| 20 | 38 | Vector expressing single chain antibody against VEGF (scAb(VEGF)), hNIS and TurboFP635 | LoxP-pEL-TurboFP635-loxP-pL-IgK-scAb(VEGF)-FLAG-pEL-hNIS |
| 21 | 39 | Vector expressing single chain antibody against VEGF (scAb(VEGF)), AQP1 and TurboFP635 | LoxP-pEL-TurboFP635-loxP-pL-IgK-scAb(VEGF)-FLAG-pEL-AQP1 |
| 22 | 44 | Vector expressing eGFP | loxM3-pEL-eGFP-loxM7 |
| 23 | 46 | Lentiviral vector encoding Cre recombinase under control of the CMV promoter | |
| 24 | 47 | Vector expressing eGFP and CRE | loxM3-pEL-eGFP-pEL-CRE-loxM7 |

TABLE X16

| Vector # | Description | Vector Construction |
|---|---|---|
| 13 | Vector expressing murine 4-1BBL + murine OX40L + TurboFP635 | loxP-pEL-TurboFP635-loxP-pEL-murine 4-1BBL-pEL-murine OX40L |
| 14 | Vector expressing canine 4-1BBL + canine OX40L + TurboFP635 | loxP-pEL-TurboFP635-loxP-pEL-canine 4-1BBL-pEL-canine OX40L |
| 15 | Vector expressing human 4-1BBL + human OX40L + TurboFP635 | loxP-pEL-TurboFP635-loxP-pEL-human 4-1BBL-pEL-human OX40L |
| 16 | Vector expressing single chain antibody against VEGF (scAb(VEGF)), murine OX40L and TurboFP635 | LoxP-pEL-TurboFP635-loxP-pL-IgK-scAb(VEGF)-FLAG-pEL-murine OX40L |
| 17 | Vector expressing single chain antibody against VEGF (scAb(VEGF)), human OX40L and TurboFP635 | LoxP-pEL-TurboFP635-loxP-pL-IgK-scAb(VEGF)-FLAG-pEL-human OX40L |
| 18 | Vector expressing single chain antibody against VEGF (scAb(VEGF)), murine 4-1BBL and TurboFP635 | LoxP-pEL-TurboFP635-loxP-pL-IgK-scAb(VEGF)-FLAG-pEL-murine 4-1BBL |
| 19 | Vector expressing single chain antibody against VEGF (scAb(VEGF)), human 4-1BBL and TurboFP635 | LoxP-pEL-TurboFP635-loxP-pL-IgK-scAb(VEGF)-FLAG-pEL-human 4-1BBL |

PCR and Sanger Sequencing

To confirm the insertion of transgenes at the intergenic locus of the recipient viruses, a primer pair was designed to amplify the intergenic region:

```
                                    (SEQ ID NO: 41)
Reverse Primer: 5' GACGAAGAAGCAAGAGATTGTGT 3'

                                    (SEQ ID NO: 42)
Forward Primer: 5' ACCGTTTCCATTACCGCCA 3'.
```

The target sequences (complements) for the two primers are located on HR-left and HR-right, respectively, of the Vaccinia virus. Amplicons from the original virus prior to Cre/Lox recombination would be primers located on HR-left and HR-right. PCR amplicon from the original non-recombinant virus will be 230 bp in length, while the new recombinant virus amplicon will have a size that is equal to the size of the inserted transgene plus an extra 140 bp from the backbone. The sequences of the PCR products from all the purified clones were confirmed by Sanger sequencing (Retrogen, Inc., San Diego, CA).

Example 12

Attenuation of CAL-01/CAL-02 Viruses by Deletion of an Anti-Apoptotic Gene and Insertion of Marker and/or Therapeutic Genes CAL-01 and CAL-02 vaccinia virus backbones can be attenuated by knocking out the viral FIL gene. VACV protein FIL is a 26-kDa protein that is expressed early after infection and is widely conserved amongst VACV strains. FIL is a potent inhibitor of intrinsic mitochondrial apoptosis. Marker genes (e.g., TurboFP635 or eGFP) and/or therapeutic genes can be introduced into the FIL locus. The CRISPR/Cas9HFc system described in Example 8 was used to generate recombinant vaccinia viruses (VACV) encoding the marker and/or therapeutic genes.

The gene encoding FIL is located at ORF_050 of CAL-01 (ACAM2000; GenBank: Accession No: AY313847.1; SEQ ID NO:70). To eliminate FIL function, a 645 bp fragment in FIL (SEQ ID NO:52) is removed and replaced with loxM7-pEL-eGFP-loxM7-MCS (SphI, EcoRI, NotI, AgeI, SwaI, AflII) (SEQ ID NO:53). 1. Guide RNA for Targeting FIL (ORF_50)

The guide RNA (gRNA) sequence (SEQ ID NOs: 54 and 55) for targeting FIL in ORF_50 was selected using online software (dna20.com/eCommerce/cas9/input). The guide RNA was constructed under the control of a U6 promoter in a lentiviral vector, resulting in a *lenti*-plasmid (SEQ ID NO:56) (vector obtained from VectorBuilder, Inc.).

2. Construction of Donor Vector to Replace FIL with eGFP

Homologous regions (HRs) to the left (SEQ ID NO:57) and right (SEQ ID NO: 58) of ORF_050 were selected based on the ACAM2000 Vaccinia virus genome sequence (GenBank Accession No: AY313847; SEQ ID NO:70). To construct the donor vector for the VACV expressing eGFP in place of FIL, the following DNA fragments were synthesized (Genewiz, Inc., San Diego, CA):

(a) 529 bp homologous left region (SEQ ID NO:57);

(b) a selective marker gene (eGFP) under the control of the VACV early/late promoter (pEL), flanked by loxM7, which can be excised as needed by CRE/lox recombinase, (loxM7-pEL-eGFP-loxM7-MCS, SEQ ID NO:53); and (c) 619 bp homologous right region (SEQ ID NO:58).

The fragments were cloned in the order (a)→ (b)→ (c) (upstream→downstream) into a pUC57 (Ampicillin) vector (SEQ ID NO:73).

3. Construction of Donor Vector to replace FIL with eGFP and anti-VEGF

To construct the donor vector for the VACV expressing eGFP and an anti-VEGF antibody in place of FIL, the following DNA fragments were synthesized (Genewiz, Inc., San Diego, CA):

(a) 529 bp homologous left region (SEQ ID NO:57);

(b) (upstream) a selective marker gene (eGFP) under the control of the VACV early/late promoter (pEL), flanked by loxM7, which can be excised as needed by CRE/lox recombinase, and a single chain antibody against VEGF (scAb(VEGF)) under control of the VACV late promoter (pL) (downstream) (loxM7-pEL-eGFP-loxM7-pL-scAb(VEGF), SEQ ID NO:69); and (c) 619 bp homologous right region (SEQ ID NO:58).

The fragments were cloned in the order (a)→ (b)→ (c) (upstream→downstream) into a pUC57 (Ampicillin) vector (SEQ ID NO:73).

Recombinant Viruses Containing Combinations of Modifications at ACAM2000 Loci

CAL-02 viruses (recombinant viruses containing therapeutic genes inserted between ORF_157 and ORF_158) were further modified to include a recombinantly inserted gene at the FIL locus and are referred to with the prefix "CAL-03."

| Virus name | Recombinant immunotherapeutic protein inserted in locus between ORF_157 and ORF_158 | Recombinant therapeutic protein inserted in F1L locus |
|---|---|---|
| CAL-03.h1 | hOX40L | scAb(VEGF) |
| CAL-03.m1 | mOX40L | scAb(VEGF) |
| CAL-03.h2 | h4-1BBL | scAb(VEGF) |
| CAL-03.m2 | m4-1BBL | scAb(VEGF) |
| CAL-03.h3 | sc-hCTLA4 | scAb(VEGF) |

Example 13

Attenuation of CAL-01/CAL-02 Viruses by Deletion of an Anti-interferon Gamma Gene (B8R) and Insertion of Marker and/or Therapeutic Genes VACV strain WR gene B8R encodes a secreted protein (B8) that binds IFNY. Protein B8 is similar to mouse and human IFNγ receptors (IFN-Rs) and to the myxoma virus protein M-T7, and acts as a soluble antagonist of IFNγ. Unlike cellular IFN-Rs that bind IFNγ mostly from the same species, B8 can bind human, bovine, rat and rabbit IFNγ with a high affinity, and can bind mouse IFNγ with a low affinity. In this example, the B8R gene is deleted and a marker gene (TurboFP635) is introduced in its place. The gene encoding B8 is located at ORF_201 of CAL-01 (ACAM2000; GenBank: Accession No: AY313847.1; SEQ ID NO:70). A 785 bp fragment in B8R (SEQ ID NO:59) is deleted and replaced with loxP-pEL-TurboFP635-loxP-MCS (EcoRI, NotI, Agel, SwaI, AflII) (SEQ ID NO:60). The TurboFP635 expression cassette can be excised as needed using the Cre/lox system.

1. Guide RNA for targeting B8R (ORF_201)

The guide RNA (gRNA) sequences (SEQ ID NOs: 61 and 62) for targeting B8R in ORF_201 were selected using online software (dna20.com/eCommerce/cas9/input). The guide RNA was constructed under the control of a U6 promoter in a lentiviral vector, resulting in a lenti-plasmid (SEQ ID NO: 63) (vector obtained from VectorBuilder, Inc.).

2. Construction of Donor Vector to Replace B8R with TurboFP635

To construct the donor vector for the VACV expressing TurboFP635 in place of B8R, the following DNA fragments were synthesized (Genewiz, Inc., San Diego, CA):

(a) 624 bp homologous left region (SEQ ID NO:64);

(b) a selective marker (TurboFP635), under the control of the VACV early/late promoter (pEL), flanked by loxP, which can be excised as needed by loxP/CRE recombinase (loxP-pEL-TurboFP635-loxP-MCS, SEQ ID NO:60); and (c) 624 bp homologous right region (SEQ ID NO:65).

The fragments were cloned in the order (a)→ (b)→ (c) (upstream→downstream) into a pUC57 (Ampicillin) vector (SEQ ID NO:73).

Example 14

Engineering Recombinant Oncolytic Viruses that Inhibit Angiogenesis

Vascular endothelial growth factor (VEGFs), as well as their receptors (VEGFRs), and angiopoietins (ANGPTs) play a role in vascular development and angiogenesis. VEGFs are a sub-family of growth factors having a highly conserved receptor-binding cystine-knot motif similar to that of the platelet-derived growth factor family. VEGFs are signaling proteins involved in both vasculogenesis and angiogenesis. Vascular endothelial growth factor A (VEGF-A), originally known as vascular permeability factor (VPF), is a signal protein produced by cells that stimulates the formation of blood vessels.

Endothelial cells express three different VEGFRs, belonging to the family of receptor tyrosine kinases (RTKs). They are named VEGFR-1 (Flt-1), VEGFR-2 (KDR/Flk-1) and VEGFR-3 (Flt-4). Their expression is almost exclusively restricted to endothelial cells, but VEGFR-1 can also be found on monocytes. All VEGFRs have seven immunoglobulin-like extracellular domains, a single transmembrane region and an intracellular split tyrosine kinase domain. VEGFR-2 has a lower affinity for VEGF than the Flt-1 receptor, but a higher signaling activity. Mitogenic activity in endothelial cells is mainly mediated by VEGFR-2, leading to their proliferation.

This example describes the construction of recombinant viruses that encode anti-angiogenesis or vascular normalization genes, such as single chain antibodies against VEGF. Solid tumors generally are characterized by aberrant vasculature that generates a hypoxic microenvironment that is immunosuppressive and impairs anti-tumor T cell activity. While oncolytic viruses (OVs) can initiate vascular shutdown within the tumor, following uptake, the uptake of subsequent doses of the OV and/or trafficking of immune cells to the tumor can be impaired by such shutdown.

Tumors counter the hypoxia-induced oxygen and nutrient deficiency by secreting factors such as VEGF, thereby initiating a form of angiogenesis; the resulting vessels, however, are plagued by structural abnormalities that hinder the delivery of therapeutics, such as cancer therapies, to the tumor core. "Vascular Normalization" using molecules that inhibit pro-angiogenic factors, such as VEGF, or upregulate anti-angiogenic factors, can restore a proper balance of these signals and repair tumor vasculature, thereby increasing the efficacy of the therapy. The recombinant viruses used in the CAVES/SNV compositions provided herein accordingly can be modified to recombinantly express anti-angiogenic factors, or factors that upregulate anti-angiogenic factors.

The site for insertion of the anti-angiogenesis factor was the previously described location site (between ORFs 157 and 158; see Example 8) in the ACAM2000 Vaccinia Virus, where therapeutic genes can be inserted without altering functional viral open reading frames (ORFs) in the resulting recombinant virus. A small middle fragment (92 bp) of a gap between ORF_157 and ORF_158 (271 bp; SEQ ID NO: 3) was selected to be replaced by gene(s) of interest. As described below, genes of interest were introduced into this intergenic area between ORF 157 and ORF_158 using the CRISPR/Cas9HFc (high fidelity Cas9) system. The following angiogenesis-inhibiting recombinant oncolytic viruses were constructed that target VEGFs, VEGFRs and/or ANGPTs.

Donor Vectors for Generating Recombinant VACV Expressing Inhibitors of Angiogenesis and a Selection Gene (TurboFP635)

Hi im TurboFP635 and Single Chain Antibody Against VEGFR-2 A donor vector for expressing a single chain antibody against the VEGFR-2 receptor (codon optimizing for Vaccinia virus), along with the marker gene TurboFP635 under control of a separate promoter, was constructed. The donor vector was constructed by linearizing Vector 1 using SphI restriction enzyme and inserting DNA encoding the heavy chain of a single chain antibody against VEGFR-2 (scAb(VEGFR-2) HC; SEQ ID NO:77) and DNA encoding the light chain of a single chain antibody against VEGFR-2 (scAb (VEGFR-2) Lc; SEQ ID NO: 79), joined by a linker sequence (SEQ ID NO: 78). The scAb(VEGFR-2) recombinant sequence was linked to DNA encoding an IgK signal sequence (SEQ ID NO:76), which facilitates cellular secretion of the antibody, DNA encoding a FLAG tag (SEQ ID NO:29), which facilitates detection, and a terminator sequence (SEQ ID NO: 80). The IgK-scAb (VEGFR-2)$_{HC}$-Linker-scAb(VEGFR-2)$_{LC}$-FLAG-Terminator sequence was codon-optimized for expression in Vaccinia virus (e.g., idtdna.com/CodonOpt) and placed under the control of Vaccinia early/late promoter (pEL; SEQ ID NO:74) or, alternatively, the late promoter (pL; SEQ ID NO:20). The resulting vector containing the loxP→pEL→TurboFP635-→10xP →pEL→IgK→scAb(VEGFR-2) HC →Linker→scAb(VEGFR-2)$_{LC}$→FLAG→Terminator sequence (upstream→downstream) was synthesized by Genewiz, Inc. (SEQ ID NO:81). The sequence of the vector was confirmed by Sanger sequencing (Retrogen, Inc., San Diego, CA). The TurboFP635 cassette can be used as a selection gene and can be excised as needed using loxP/CRE recombinase. The IgK-scAb(VEGFR-2)$_{HC}$-Linker-scAb (VEGFR-2)$_{LC}$-FLAG-Terminator sequence can alternatively be constructed under control of Vaccinia virus late promoter (pL; SEQ ID NO:20), and/or without a FLAG tag.

(2) TurboFP635 and Recombinant Fusion Protein Containing Portions of the Extracellular Domains of Human VEGFRs 1 and 2 Fused to the Fc Portion of Human IgG1

The extracellular domain sequences come from two different VEGFRs, VEGFR-1 (also known as Flt-1) and VEGFR-2 (also known as KDR or Flk-1). Each of the VEGFRs are composed of seven immunoglobulin (Ig) domains in their extracellular regions, with Ig domains 2 and 3 contributing the majority of the binding energy for VEGF. This construct is targeted at binding vascular endothelial growth factor A (VEGF-A), vascular endothelial growth factor B (VEGF-B), and placental growth factor (PGF), a growth factor found in placenta which is homologous to vascular endothelial growth factor. VEGFR-1 acts as a cell-surface receptor for VEGF-A, VEFG-B and PGF; VEGFR-2 acts as a cell-surface receptor for VEGF-A, and vascular endothelial growth factors C and D (VEGF-C and VEGF-D, respectively).

A donor vector for expressing a Vaccinia virus codon optimized fusion protein containing portions of VEGFR-1 and VEGFR-2 extracellular domains fused to the Fc portion of human IgG1 ("fusion protein"), along with the marker gene TurboFP635 under control of a separate promoter, was constructed. The donor vector was constructed by linearizing Vector 1 using SphI restriction enzyme and inserting DNA encoding the fusion protein (SEQ ID NO:82) linked to DNA encoding an IgK signal sequence (SEQ ID NO:76), which facilitates cellular secretion of the antibody, DNA encoding a FLAG tag (SEQ ID NO:29), which facilitates detection, and a terminator sequence (SEQ ID NO:80). The IgK-fusion protein-FLAG-Terminator sequence was codon-optimized for expression in Vaccinia virus (e.g., idtdna.com/CodonOpt) and placed under the control of Vaccinia early/late promoter (pEL; SEQ ID NO:74). The resulting vector containing the loxP→pEL→TurboFP635→10xP→pEL→IgK→fusion protein→FLAG →Terminator sequence (upstream→downstream) was synthesized by Genewiz, Inc. (SEQ ID NO:83). The sequence of the vector was confirmed by Sanger sequencing (Retrogen, Inc., San Diego, CA). The TurboFP635 cassette can be used as a selection gene and can be excised as needed using loxP/CRE recombinase. The IgK-scAb(VEGF-A fusion protein)-FLAG-Terminator sequence alternatively can be constructed under control of Vaccinia virus late promoter (pL; SEQ ID NO:20), and/or without a FLAG tag.

(3) TurboFP635 Single Chain Antibody Against ANGPT2

ANGPT2 encodes an antagonist of angiopoietin 1 (ANGPT1) and endothelial TEK tyrosine kinase (TIE-2, TEK). ANGPT2 disrupts the vascular remodeling ability of ANGPT1 and can induce endothelial cell apoptosis.

A donor vector for expressing a single chain antibody against ANGPT2 (codon optimizing for Vaccinia virus), along with the marker gene TurboFP635 under control of a separate promoter, was constructed. The donor vector was constructed by linearizing Vector 1 using SphI restriction enzyme and inserting DNA encoding the heavy chain of a single chain antibody against ANGPT2 (scAb(ANGPT2) HC; SEQ ID NO: 84) and DNA encoding the light chain of a single chain antibody against ANGPT2 (scAb(ANGPT2)$_{LC}$; SEQ ID NO:85), joined by a linker sequence (SEQ ID NO: 78). The scAb(ANGPT2) recombinant sequence was linked to DNA encoding an IgK signal sequence (SEQ ID NO:76), which facilitates cellular secretion of the antibody, DNA encoding a FLAG tag (SEQ ID NO:29), which facilitates detection, and a terminator sequence (SEQ ID NO:80). The IgK-scAb(ANGPT2)$_{HC}$-Linker-scAb (ANGPT2)$_{LC}$-FLAG-Terminator sequence was codon-optimized for expression in Vaccinia virus (e.g., idtdna.com/CodonOpt) and placed under the control of Vaccinia early/late promoter (pEL; SEQ ID NO:74). The resulting vector containing the loxP→pEL→TurboFP635-→1oxP→pEL→IgK→scAb(ANGPT2) HC →→ Linker→scAb(ANGPT2)$_{LC}$→FLAG→Terminator sequence (upstream→downstream) was synthesized by Genewiz, Inc. (SEQ ID NO:86). The sequence of the vector was confirmed by Sanger sequencing (Retrogen, Inc., San Diego, CA). The TurboFP635 cassette can be used as a selection gene and can be excised as needed using loxP/CRE recombinase. The IgK-scAb(ANGPT2)$_{HC}$-Linker-scAb (ANGPT2)$_{LC}$-FLAG-Terminator sequence alternatively can be constructed under control of Vaccinia virus late promoter (pL; SEQ ID NO:20), and/or without a FLAG tag.

(4) TurboFP635 and Single Chain Antibody Against VEGF-A

A donor vector for expressing a single chain antibody against VEGF-A (codon optimizing for Vaccinia virus), along with the marker gene TurboFP635 under control of a separate promoter, was constructed. The donor vector was constructed by linearizing Vector 1 using SphI restriction enzyme and inserting DNA encoding the heavy chain of a single chain antibody against VEGF-A (scAb(VEGF-A) HC; SEQ ID NO: 87) and DNA encoding the light chain of a single chain antibody against VEGF-A (scAb(VEGF-A)$_{LC}$; SEQ ID NO:88), joined by a linker sequence (SEQ ID NO: 78). The scAb(VEGF-A) recombinant sequence was linked to DNA encoding an IgK signal sequence (SEQ ID NO:76), which facilitates cellular secretion of the antibody, DNA encoding a FLAG tag (SEQ ID NO:29), which facilitates detection, and a terminator sequence (SEQ ID NO:80). The IgK-scAb(VEGF-A)$_{HC}$-Linker-scAb (VEGF-A)$_{LC}$-FLAG-Terminator sequence was codon-optimized for expression in Vaccinia virus (e.g., idtdna.com/CodonOpt) and placed under the control of Vaccinia early/late promoter (pEL; SEQ ID NO:74). The resulting vector containing the loxP→pEL→TurboFP635-→loxP→pEL→IgK→scAb (VEGF-A) HC →Linker→scAb(VEGF-A)$_{LC}$→FLAG→Terminator sequence (upstream→downstream) was synthesized by Genewiz, Inc. (SEQ ID NO:89). The sequence of the vector was confirmed by Sanger sequencing (Retrogen, Inc., San Diego, CA). The TurboFP635 cassette can be used as a selection gene and can be excised as needed using loxP/CRE recombinase. The IgK-scAb(VEGF-A)$_{HC}$-Linker-scAb (VEGF-A)$_{LC}$-FLAG-Terminator sequence can alternatively be constructed under control of Vaccinia virus late promoter (pL; SEQ ID NO:20), and/or without a FLAG tag.

Donor Vectors Encoding Two Single Chain Antibodies and a Selection Gene (TurboFP635)

(1) Single Chain Antibody Against VEGF-A and Single Chain Antibody Against ANGPT2 in the Opposite Direction A donor vector for expressing two inhibitors of angiogenesis: a single chain antibody against VEGF-A and a single chain antibody against ANGPT-2 (codon optimized for Vaccinia virus), each independently controlled by a pEL (SEQ ID NO: 74) or pL (SEQ ID NO:20) promoter, along with the marker gene TurboFP635 under control of a separate promoter, was constructed. An exemplary donor vector encoded: (a) a single chain antibody against VEGF-A (scAb (VEGF-A)) linked to DNA encoding an IgK signal sequence, a FLAG tag and a terminator sequence, and under the control of Vaccinia virus early/late promoter (pEL; SEQ ID NO:74); and (b) in an orientation opposite to (a), a single chain antibody against ANGPT2 (scAb(ANGPT2)) linked to DNA encoding an IgK signal sequence, a FLAG tag and a terminator sequence, and under the control of Vaccinia virus early/late promoter (pEL; SEQ ID NO:74).

The donor vector was constructed by linearizing Vector 1 using SphI restriction enzyme and inserting: (1) DNA encoding the heavy chain of a single chain antibody against VEGF-A (scAb(VEGF-A) HC; SEQ ID NO:87) and DNA encoding the light chain of a single chain antibody against VEGF-A (scAb(VEGF-A)$_{LC}$; SEQ ID NO: 88), joined by a linker sequence (SEQ ID NO:78), and further linked to DNA encoding an IgK signal sequence (SEQ ID NO:76), which facilitates cellular secretion of the antibody, DNA encoding a FLAG tag (SEQ ID NO:29), which facilitates detection, and a terminator sequence (SEQ ID NO:80); and (2) DNA encoding the heavy chain of a single chain antibody against ANGPT2 (scAb(ANGPT2) HC; SEQ ID NO: 84) and DNA encoding the light chain of a single chain antibody against ANGPT2 (scAb(ANGPT2)$_{LC}$; SEQ ID NO:85), joined by a linker sequence (SEQ ID NO: 78), and further linked to DNA encoding an IgK signal sequence (SEQ ID NO: 76), which facilitates cellular secretion of the antibody, DNA encoding a FLAG tag (SEQ ID NO:29), which facilitates detection, and a terminator sequence (SEQ ID NO: 80). The IgK-scAb(VEGF-A)$_{HC}$-Linker-scAb(VEGF-A)$_{LC}$-FLAG-Terminator sequence was codon-optimized for expression in Vaccinia virus (e.g., idtdna.com/CodonOpt) and placed under the control of Vaccinia early/late promoter (pEL; SEQ ID NO:74). The IgK-scAb(ANGPT2)$_{HC}$-Linker-scAb (ANGPT2)$_{LC}$-FLAG-Terminator sequence was codon-optimized for expression in Vaccinia virus (e.g., idtdna.com/CodonOpt) and placed under the control of Vaccinia early/late promoter (pEL; SEQ ID NO:74). The IgK-scAb(VEGF-A)$_{HC}$-Linker-scAb(VEGF-A) LC-FLAG-Terminator sequence and the IgK-scAb(ANGPT2)$_{HC}$-Linker-scAb (ANGPT2)$_{LC}$-FLAG-Terminator sequence were inserted opposite orientations. The resulting vector containing the loxP→pEL→TurboFP635 →loxP→pEL→IgK→scAb (VEGF-A)$_{HC}$→Linker→scAb(VEGF-A)$_{LC}$→FLAG→ Terminator<Terminator<FLAG <-scAb(ANGPT2)$_{LC}$< Linker <-scA b (ANGPT2) HC<IgK <-pEL sequence (upstream→downstream) was synthesized by Genewiz, Inc. (SEQ ID NO:90). The sequence of the vector was confirmed by Sanger sequencing (Retrogen, Inc., San Diego, CA). The TurboFP635 cassette can be used as a selection gene and can be excised as needed using loxP/CRE recombinase. Both the IgK-scAb(VEGF-A)$_{HC}$-Linker-scAb (VEGF-A)$_{LC}$-FLAG-Terminator sequence and the IgK-scAb(ANGPT2)$_{HC}$-Linker-scAb(ANGPT2)$_{LC}$-FLAG-Terminator sequence can alternatively be constructed under control of Vaccinia virus late promoter (pL; SEQ ID NO:20), and/or without a FLAG tag.

Example 15

CAVES Enhance the Therapeutic Efficacy of Checkpoint Inhibitors

This example demonstrates that the CAVES compositions provided herein can increase the therapeutic efficacy of other therapeutic agents, such as checkpoint inhibitors, when administered as a combination therapy.

Murine Colon Cancer Model (CT26)

Colon tumors were generated by injecting 2×106 CT26 cells subcutaneously into the right flank of 4-6 week athymic nude mice. 8 days after injection of the tumor cells, mice were treated as follows:

(1) Injected intratumorally with $1\times10^6$ SNV-1c (Day 0);

(2) Treated by systemic administration of anti-PD1 (200 μg per animal, i.p., clone RMP1-14, Bio X Cell);

(3) Injected intratumorally with $1\times10^6$ SNV-1c (Day 0) and administered anti-PD1 systemically on Day 2; or (4) Control mice, which were treated intratumorally with PBS (n=8 per treatment group).

For a single intratumoral injection, the data demonstrated that at Day 17 following intratumoral injection into the CT26 tumor, the control animals showed an average tumor volume of about 2000 mm$^3$. By comparison, treatment with anti-PD1 resulted in an average tumor volume of about 1450 mm$^3$ at Day 17. Treatment with SNV-1c resulted in a slightly greater slowing of tumor progression, with an average tumor volume of about 1200 mm$^3$ at Day 17. Mice treated with both anti-PD1 and SNV-1c showed a synergistic benefit, with an average tumor volume of about 900 mm$^3$ at Day 17.

In another experiment, $2\times10^6$ CT26 colon cancer mouse cells were injected subcutaneously in the right flank of immunocompetent BALB/c mice. Ten (10) days after tumor inoculation, mice were treated with single dose of $1\times10^6$ CAVES or CAVES in combination with anti-mouse PD1 (200 μg per animal, clone RMP1-14, Bio X Cell) for 3 times, every 2 days. CAVES were generated by infecting stem cells with CAL1 virus at MOI of 0.1 and harvest at 28 h post infection. Anti-PD1 was intraperitoneally administered 2 days after CAVES injection. The data in the Table below shows that the anti-PD1 therapeutic efficacy was enhanced when combined with CAVES treatment.

CT-26 (murine prostate tumor model)

| | Control (PBS) Tumor volume (mm$^3$) | | aPD1 (anti-PD1) Tumor volume (mm$^3$) | | CAVES Tumor volume (mm$^3$) | | CAVES + aPD1 (aPD1 start at day 2) Tumor volume (mm$^3$) | |
|---|---|---|---|---|---|---|---|---|
| Animals | Day 0 | Day 17 | Day 0 | Day 17 | Day 0 | Day 17 | Day 0 | Day 17 |
| 1 | 45.66 | 2391.91 | 93.86 | 2245.35 | 53.15 | 408.47 | 69.62 | 845.52 |
| 2 | 85.76 | 2047.24 | 36.50 | 675.82 | 46.96 | 1258.89 | 97.80 | 1079.96 |
| 3 | 57.61 | 2073.61 | 57.79 | 1391.17 | 74.63 | 1673.25 | 62.80 | 1214.82 |
| 4 | 93.69 | 3181.99 | 79.59 | 2065.04 | 65.44 | 1446.70 | 78.43 | 1050.11 |
| 5 | 70.84 | 2179.81 | 45.77 | 2712.67 | 96.47 | 1728.38 | 47.76 | 1901.60 |
| 6 | 36.37 | 875.76 | 87.79 | 1869.78 | 88.83 | 1122.36 | 43.51 | 1013.51 |
| 7 | 78.73 | 3295.78 | 82.60 | 1818.25 | 42.46 | 50.69 | 59.04 | 934.00 |
| 8 | 98.39 | 2026.48 | 52.16 | 532.16 | 34.85 | 2038.22 | 36.34 | 91.99 |
| 9 | 62.55 | 2230.72 | 74.43 | 1908.47 | 80.41 | 2426.47 | 92.03 | 1065.06 |
| 10 | | | | | 58.17 | 576.56 | 55.63 | 482.67 |
| Average | 69.96 | 2255.92 | 67.83 | 1690.97 | 64.14 | 1273.00 | 64.30 | 967.92 |
| SD | 21.29 | 706.94 | 20.28 | 711.50 | 20.58 | 750.05 | 20.31 | 469.32 |
| GEOMEAN | 66.77 | 2134.30 | 64.86 | 1510.08 | 61.08 | 900.08 | 61.43 | 793.66 |

Prostate Cancer Model

Prostate tumors were generated by injecting 2×106 RM1 prostate cancer cells subcutaneously into the right flank of 4-6 week athymic nude mice. 20 days after injection of the tumor cells, the mice were treated as follows:

(1) Injected intratumorally with $1\times10^6$ SNV-1c (Day 0);

(2) Treated by systemic administration of anti-PD1 (200 μg per animal, i.p., clone RMP1-14, Bio X Cell);

(3) Injected intratumorally with $1\times10^6$ SNV-1c (Day 0) and administered anti-PD1 systemically on Day 2;

(4) Injected intratumorally with $1\times10^6$ SNV-3c: 1×105 pfu CAL3 virus (see Example 12) incubated with adipose derived stem cells (MOI=0.2 for 28 h) (5) Injected intratumorally with $1\times10^6$ SNV-3c (Day 0) and administered anti-PD1 systemically on Day 2; or (6) Control mice, which were intratumorally injected with PBS (n=8 per treatment group).

For a single intratumoral injection, the data demonstrated that at Day 10 following intratumoral injection into the CT26 tumor, the control animals showed about a 45-50 fold average increase in tumor volume. The average fold increase in tumor volume for the animals treated with anti-PD1 alone was similar to that of the control. Treatment with SNV-1c resulted in a significant slowing of tumor progression, with an average fold increase in tumor volume of about 16-fold. By comparison, mice treated with both anti-PD1 and SNV-1c showed an average fold increase in tumor volume of about 24-25 fold.

The SNV-3c composition, which contains a virus that expresses an anti-angiogenesis factor, was found to be more effective at enhancing the therapeutic effects of anti-PD1. Treatment with SNV-3c resulted in a significant slowing of tumor progression, with an average fold increase in tumor volume of about 12-fold at Day 10. Mice treated with both anti-PD1 and SNV-3c showed a greater slowing of tumor progression, with an average fold increase in tumor volume of about 7 fold at Day 10.

Thus, compositions provided herein can be used in combination therapy with other anti-cancer treatments and agents, such as checkpoint inhibitors, to enhance the efficacy thereof.

Since modifications will be apparent to those of skill in the art, it is intended that this invention be limited only by the scope of the appended claims.

SEQUENCE LISTING (95 sequences)

SEQ ID NO: 1 - RNA, 20 nt, synthetic construct
  misc_feature 1..20: note = gRNA1 targeting DNA within the 92 bp intergenic area (SEQ ID NO:6)
  source 1..20: mol_type = other RNA
tattgatgtcgaaaaggagc

SEQ ID NO: 2 - DNA, 7705 bp, synthetic construct
  misc_feature 1..7705: note = Vector encoding gRNA1 (SEQ ID NO:1)
  source 1..7705: mol_type = other DNA
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgctagcttttaaaagaaaaggggggattggggggtacagtgcaggggaaagaatagtagacataatagcaacagacatacaaactaaagaattacaaaaacaaattacaaaaattcaaaattttactagtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcgaggaaaagctgtagttatgttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtaccgaattccaactttgtatagaaaagttggggttgcgccttttccaaggcagccctgggtttgcgcagggacgcggctgctctgggcgtggttccgggaaacgcagcggcgccgaccctgggtctcgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccaggcaagtttgtacaaaaaagcaggctgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaacccagctttcttgtacaaagtggtggtacccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagagagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3 - DNA, 271 bp, synthetic construct
  misc_feature 1..271: note = Intergenic locus between ORF_157 and ORF_158
  source 1..271: mol_type = other DNA
agatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgag

SEQ ID NO: 4 - DNA, 555 bp, synthetic construct
  misc_feature 1..555: note = Homologous region to the right of the intergenic locus between ORF_157 and ORF_158
  source 1..555: mol_type = other DNA
aagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaaga

SEQ ID NO: 5 - DNA, 642 bp, synthetic construct
  misc_feature 1..642: note = Homologous region to the left of the intergenic locus between ORF_157 and ORF_158
  source 1..642: mol_type = other DNA
gatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcg

SEQ ID NO: 6 - DNA, 92 bp, synthetic construct
  misc_feature 1..92: note = Sequence within the intergenic locus between ORF_157 and ORF_158 that is replaced by the therapeutic gene of interest
  source 1..92: mol_type = other DNA
aaatatcgttccagctccttttcgacatcaataactttagcacgttgtctctcaagctctcttttgtagttatctgattccctggcacgttt

SEQ ID NO: 7 - DNA, 740 bp, synthetic construct
  misc_feature 1..740: note = DNA fragment containing the multiple cloning site 1 and the left homologous region
  source 1..740: mol_type = other DNA
caatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacatt

SEQ ID NO: 8 - DNA, 961 bp, synthetic construct
  misc_feature 1..961: note = DNA fragment containing the multiple cloning site 2, loxP, red fluorescent protein TurboFP635 flanked by the Vaccinia virus early/late promoter (pEL; SEQ ID NO:19) and multiple cloning site 3
  source 1..961: mol_type = other DNA
gagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcgatatcatttaaatgcggccgcgagctc

SEQ ID NO: 9 - DNA, 4659 bp, synthetic construct
  misc_feature 1..4659: note = Vector 1 (pIg-loxP-TurboFP635)
  source 1..4659: mol_type = other DNA
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcgatatcatttaaatgcggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 10 - DNA, 729 bp, synthetic construct
  misc_feature 1..729: note = Single chain antibody against VEGF (scAb(VEGF))
  source 1..729: mol_type = other DNA
gaggtgcagttggttgagtcgggaggtggtttggttcaacctggaggtagtcttcgattatcttgcgcagccagtggtttcactataagtgattattggattcattgggttcgtcaagcccccggtaagggattagaatgggttgcaggaataacaccagccggtggatatacgtattacgccgactccgttaagggacgttttacgatttcagccgacacgtctaaaaacactgcgtaccttcagatgaattctcttagagctgaagatacggcagtgtactactgtgctcgttttgtgtttttcttgccttacgcaatggattactggggacagggaactctagttacggtttcatcgggaggaggtggttctggtggaggtggatccggaggaggtggttcggatattcaaatgacccagtcgccaagttccttatcagcatctgtgggagacagagtgacaatcacttgtagagcttcgcaagatgtatccacggctgtagcttggtatcaacaaaagccaggtaaagctccaaaactattaatatactcagcatcatttctatattctggtgtaccttcccgattctcgggttcgggttctggaaccgatttcaccttgaccatcagttcgttacaaccggaggatttcgccacatattactgccaacaaggatatggtaatccattcacttttggacaaggaacgaaggtagaaatcaagcga

SEQ ID NO: 11 - DNA, 63 bp, synthetic construct
  misc_feature 1..63: note = IgK signal peptide
  source 1..63: mol_type = other DNA
atggagactgatacccttcttttatgggtcctacttttatgggtgccgggttcaacgggagat

SEQ ID NO: 12 - DNA, 1811 bp, synthetic construct
  misc_feature 1..1811: note = Vector 3 (loxP-pEL-TurboFP635-loxP-pL-IgK-scAb(VEGF)-FLAG)
  source 1..1811: mol_type = other DNA
ataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgttttttttttttttttttttggcatataaataagccgaccaccatggagactgatacccttcttttatgggtcctacttttatgggtgccgggttcaacgggagatgaggtgcagttggttgagtcgggaggtggtttggttcaacctggaggtagtcttcgattatcttgcgcagccagtggtttcactataagtgattattggattcattgggttcgtcaagcccccggtaagggattagaatgggttgcaggaataacaccagccggtggatatacgtattacgccgactccgttaagggacgttttacgatttcagccgacacgtctaaaaacactgcgtaccttcagatgaattctcttagagctgaagatacggcagtgtactactgtgctcgttttgtgtttttcttgccttacgcaatggattactggggacagggaactctagttacggtttcatcgggaggaggtggttctggtggaggtggatccggaggaggtggttcggatattcaaatgacccagtcgccaagttccttatcagcatctgtgggagacagagtgacaatcacttgtagagcttcgcaagatgtatccacggctgtagcttggtatcaacaaaagccaggtaaagctccaaaactattaatatactcagcatcatttctatattctggtgtaccttcccgattctcgggttcgggttctggaaccgatttcaccttgaccatcagttcgttacaaccggaggatttcgccacatattactgccaacaaggatatggtaatccattcacttttggacaaggaacgaaggtagaaatcaagcgagactacaaagacgacgacgacaaataattaattaatttttatcgatctaattcaacaatgtctgga

SEQ ID NO: 13 - DNA, 6679 bp, synthetic construct
  misc_feature 1..6679: note = Vector 4 (loxP-pEL-TurboFP635-loxP-pE-hNIS)
  source 1..6679: mol_type = other DNA
ttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcgatatcatttaaatgcggccaaaaattgaaaaactagcgtctttttttgctcgaagtcgaccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgattaattaatttttatcgatctaattcaacaatgtctggaggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacac

SEQ ID NO: 14 - DNA, 1932 bp, Homo sapiens
  misc_feature 1..1932: note = human sodium iodide symporter (hNIS)
  source 1..1932: mol_type = genomic DNA
atggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctga

SEQ ID NO: 15 - DNA, 45 bp, synthetic construct
  misc_feature 1..45: note = Vaccinia virus early promoter (pE)
  source 1..45: mol_type = other DNA
aaaaattgaaaaactagcgtctttttttgctcgaagtcgaccacc

SEQ ID NO: 16 - DNA, 1404 bp, synthetic construct
  misc_feature 1..1404: note = Exemplary single chain antibody against human CTLA-4 (h-scAb(CTLA-4))
  source 1..1404: mol_type = other DNA
atagtgttgacccagagtccaggtactcttagtttaagtccaggagagcgagccactttgtcatgccgagcttcacagtcagtaggttcgtcttacttggcctggtaccaacaaaaaccgggacaggctccgagattacttatttacggtgctttttcccgtgcgacgggtataccagacagattctccggatccggttccggtactgactttaccttgacaatcagtcgtttagagccagaagatttcgccgtctactactgccaacagtacggatcctccccttggactttcggtcaaggaactaaagtagaaataaagagaggtggaggaggtagtggaggtggaggatcgggaggaggaggttcacaagtccaacttgtcgaatcaggaggtggagtggtgcagccaggacgttcactacgtttgtcttgcgcggcgtccggatttacattttcctcctatacgatgcactgggtacgtcaagctcctggtaagggtcttgagtgggtcacctttatctcctacgatggaaacaataagtattacgcggactcagtaaaaggtcgatttactatttcacgagataattctaaaaacacgctttatttgcaaatgaactccttacgtgcagaggatactgcgatttattattgtgcgcgaacaggatggctaggtccttttgattattggggacagggtactcttgttacagtttcatcagataaaactcatacttgcccaccgtgcccagccccggagttgctaggtggaccctccgtattcttgttccctcctaaaccgaaggacacgcttatgatttctagaactcccgaagttacgtgtgttgtggtagatgtttcccatgaggatcccgaggtgaaatttaactggtacgtcgacggagttgaggtgcataacgcgaagacgaaacccagagaagagcagtacaactcgacgtaccgtgttgtatccgtattaacagtactacatcaggactggttgaacggaaaagaatacaaatgcaaggtttcaaataaggctcttccagccccaatagagaaaacaatctctaaagcaaaaggacaaccacgtgagccccaggtatataccttaccgccaagtagagaggagatgaccaaaaatcaagtctccttgacttgcttggtcaagggattttacccgtcggacatcgccgttgaatgggaatccaacggtcagcctgaaaacaactacaaaacaactccaccagttttggattccgacggatcttttttcctatacagtaagctaaccgtagacaaatcgcgatggcaacagggtaacgtgttttcttgttcggtcatgcacgaggctttgcacaaccattacactcaaaagtctctatcgcttagtccaggtaag

SEQ ID NO: 17 - DNA, 1053 bp, synthetic construct
  misc_feature 1..1053: note = Exemplary single chain antibody against human CTLA-4 (h-scAb(CTLA-4))
  source 1..1053: mol_type = other DNA
atggagactgatacccttcttttatgggtcctacttttatgggtgccgggttcaacgggagatggcgttgtccagcctggaagatcacttagattatcatgcgccgcttccggttttactttttcttcgtacggaatgcactgggtacgtcaagccccaggtaagggtttggaatgggtcgcagtgatatggtatgatggatctaataagtattatgccgattccgtgaagggacgatttaccatctcgcgagacaattctaagaacactctatacttgcaaatgaacagtcttcgtgctgaagacactgctgtttattattgcgcccgagatcccagaggagcaaccctatactattattactacagatgggatgtgtggggacagggtacgacggtcaccgtctcttccgcgagtaccaaaggaccctctgtattccctcttgctccatgttcccgttcaacttcggaatctacggcggcacttggatgccttgttaaggattactttcccgagcctgtcactgtgtcctggaactccggagctttaacctcgggagttcatggaggaggtggttctggtggaggtggatccggaggaggtggttcgccgtcatccctatcggccagtgttggagatagagtcacaattacctgccgagcatctcaaagtatcaactcataccttgactggtatcagcagaagccaggtaaggcacccaagttgttaatatacgcggcttcttctttgcagtcgggagtaccctcccgattctcgggttcaggttcgggaactgacttcactttaaccatctcttcattacaacccgaagacttcgctacatattactgtcagcaatattattctacacctttcactttcggaccgggaacgaaagtcgagattaagcgtaccgtcgcggctccctcggtgttcattttccctccatctgacgagcagcttaaatcgggtacagcctcggtggtgtgcctattaaacaacttttatccaagagaggcgaaggtggactacaaagacgacgacgacaaataa

SEQ ID NO: 18 - DNA, 63 bp, synthetic construct
  misc_feature 1..63: note = IgK signal peptide
  source 1..63: mol_type = other DNA
atggaaacggacactttattgttgtgggtgctattgttgtgggtccctggttcaacgggtgac

SEQ ID NO: 19 - DNA, 58 bp, synthetic construct
  misc_feature 1..58: note = Vaccinia virus early/late promoter (pEL) + Kozak sequence
  source 1..58: mol_type = other DNA
aaaaattgaaattttattttttttttttggaatataaataagctcgaagtcgaccacc

SEQ ID NO: 20 - DNA, 43 bp, synthetic construct
  misc_feature 1..43: note = Vaccinia virus late promoter (pL)
  source 1..43: mol_type = other DNA
ttttttttttttttttttttggcatataaataagccgaccacc

SEQ ID NO: 21 - DNA, 1497 bp, synthetic construct
  misc_feature 1..1497: note = Single chain antibody against murine CTLA-4 (m-scAb(CTLA-4))
  source 1..1497: mol_type = other DNA
attcgtcgtgctgatatagtaatgactcagactacactttctctacctgtatcgttaggtgaccaagccagtatatcttgtcgttcttctcagtccatcgtgcatagtaatggtaacacctacttagagtggtacctacaaaagccgggtcagtcaccaaagttattaatctacaaggtttcaaaccgattctctggagttcctgacagatttagtggttccggatccggtaccgacttcaccctaaagatttcaagagtggaggcagaagacttgggagtgtattactgtttccagggatctcacgtcccgtacacatttggaggtggaaccaaattagagatcaagagagccgacgcggcgcctactgtgagtggtagtggaggaggaggttcgggtggtggtggttccggaggaggtggttcagaagccaagttgcaagaatcgggacctgttttagtaaagccgggtgcttctgtaaagatgtcttgtaaggcgagtggttatacgtttactgattactacatgaattgggtcaaacaatcacacggaaagagtcttgaatggatcggtgtgattaatccatacaatggtgatacgtcttacaaccagaaatttaagggaaaagctacactaacagtagacaagtcatctagtacagcctacatggagcttaactctttgacctcggaagactctgccgtctactactgcgcgcgttactatggatcctggtttgcttattggggacagggaactctaattactgtatctactgcgaaaaccaccccgccatccgtgtatccattagccccgagatcgtcgcgtggttgtaaaccgtgtatctgcactgttccagaggtttcctcggtgttcatattccctcccaagccgaaggacgttcttactattacccttacgccaaaggtcacttgtgtcgttgttgatatctccaaagacgatcctgaggtacagttttcttggttcgtcgacgatgttgaagtacacacggcgcaaacacaacctcgtgaagagcaattcaattccacttttagatcagtgtccgaattacccatcatgcaccaggactggttaaacggtaaagaattcaaatgtagagtgaactccgctgcgtttccagctccgatcgaaaagaccatctccaagactaaaggtcgacccaaggcgccccaagtctacacgataccaccccccaaagagcagatggccaaggacaaggtgagtttaacgtgtatgataacggacttcttccctgaagatataactgtagagtggcagtggaatggtcagccggcggaaaactataaaaacactcagcctattatggacaccgacggttcatatttcgtgtattccaaacttaacgtgcagaaatctaactgggaagcgggtaatacctttacgtgctcggtcctacatgaaggacttcataatcatcatacagaaaaatctttatctcattcacccggtaaatga

SEQ ID NO: 22 - DNA, 597 bp, Mus musculus
  misc_feature 1..597: note = Murine OX40L
  source 1..597: mol_type = genomic DNA
atggaaggtgaaggtgtccaacccctagatgagaacctagagaatggatcaagacctcgtttcaaatggaagaaaacactaagattggtggtatccggtataaaaggagcgggaatgctattgtgttttatctacgtgtgtctacaattatcatcctcaccggctaaagaccccccaatacaacgactacgaggtgcagtgactcgttgtgaagacggtcagttatttatttcatcttacaaaaacgaatatcaaacaatggaagttcagaacaactctgtcgttataaagtgtgatggtctttacattatttacttgaaaggttcattctttcaagaggtgaaaatagacttgcatttccgagaagaccacaatccgatctcgataccgatgcttaatgatggtagacgaattgtttttacagtcgtagcgtcattagccttcaaagacaaagtatacctaaccgtgaatgcaccggataccttatgtgagcacctacaaataaacgatggtgaattaattgtagtacaattaacccctggttattgtgcgcctgagggttcctaccattcaacagtgaatcaggttcccttgtga

SEQ ID NO: 23 - DNA, 552 bp, Canis lupus
  misc_feature 1..552: note = Canine OX40L
  source 1..552: mol_type = genomic DNA; sub_species = familiaris
atggaaggggtccaacccctggaccagaatgtgggaaacacaccagggcgaagattccagaagaacaaggtattgctggtggcagccataattcaggggctgggtctgctcctgtgtttcacctacatctgcctgcacttctatgcttctcaggtgccgcctcagtatcctccaattcaaagtatcagagtacaatttaccaggtgtgagaatgagaaaggttgcatcatcacatccccaagcaaggatgaaactatgaaggtgcaagacaactcaatcatcattaactgtgatgggttttatctcatctccctgaagggttacttctctgaggagctcagcctcagcctttattaccgaaagggtcggggacccctcttctctctgagcaaggtcacatctgttgactccattggagtggcctatctggctttcaaggacaaagtctactttaatgtgaccactcacagtacctcctacaaagacatccaggtgaatggtggggaattgattctcattcatcaaaatcctggtggcttctgtgcctactga

SEQ ID NO: 24 - DNA, 552 bp, Homo sapiens
  misc_feature 1..552: note = human OX40L
  source 1..552: mol_type = genomic DNA
atggaacgagtgcagccgttagaggaaaacgtgggtaatgcagcgagaccgcgatttgaacgaaataagctattattggttgccagtgtcatccaaggtttgggtcttctattgtgcttcacatacatttgtttgcattttagtgcccttcaagtctcgcacagatacccgagaatacagtcaataaaagttcagttcacggagtataagaaagaaaagggttttatcttgaccagtcagaaggaggacgagataatgaaagtccaaaacaattccgtcattattaactgcgacggattctatcttatctctctaaaaggttacttctctcaagaggtgaacatctcactacactaccagaaagacgaagagcctcttttccagctaaaaaaagtgcgttccgtgaactctctaatggttgcatcattaacttacaaagataaagtttacttgaacgtcacaacagataacacatccctagacgattttcacgtcaacggtggtgagcttattcttatccaccagaaccccggagagttttgcgttctatga

SEQ ID NO: 25 - DNA, 930 bp, Mus musculus
  misc_feature 1..930: note = Murine 4-1BBL
  source 1..930: mol_type = genomic DNA
atggatcaacatactttggacgtagaggatactgccgacgcacgtcatcccgccggtacctcctgcccttcggacgccgcgttacttagagatactggtttacttgcagacgcggcgctactatcagacaccgtccgtcccaccaacgcagcgctaccgaccgatgcggcctatcctgctgtgaacgtaagagaccgagaggcggcgtggccgccagctttaaacttttgctcccgacatcccaaattgtatggtctagttgcacttgttttgttgttattgatcgctgcttgcgtccccatatttactagaaccgaacctcgacccgccctaactataactacatccccaaacctaggaacccgtgagaataacgcagaccaggtaaccccagtatcccacatcggttgtccaaacactactcagcagggttccccagtatttgctaaattactagccaagaatcaagcatccttgtgtaacaccaccttaaactggcatagtcaagacggtgccggtagttcgtacctttcgcagggtttacgatacgaggaagacaaaaaagagctagttgttgactcaccgggtttatattatgtattcctagagctaaagttgtcccctacgttcactaatactggtcataaggtacagggttgggtatcacttgtgttgcaagctaagccccaagtggacgacttcgacaacttagctttaactgtcgagttgttcccgtgctcaatggaaaacaaattggtcgacagaagttggtctcaattgttattactaaaagccggtcaccgtctaagtgtgggactacgtgcatatttacacggagcacaagacgcatacagagattgggaattgagttacccaaacaccacgtcctttggtttatttttggtgaaaccggataatccctgggaatga

SEQ ID NO: 26 - DNA, 897 bp, Canis lupus
  misc_feature 1..897: note = Canine 4-1BBL
  source 1..897: mol_type = genomic DNA; sub_species = familiaris
atgcgcccccgcagcgacgccgccccggaccccgaggccccgcggccgcccgcgccccccggccgcgcctgcagcccgctgccctgggcgctgagcgccgcgatgctgctgctcgtcggcacctgcgccgcctgcgcgctccgcgcctgggtggtccccgggccccggccccccgcgctccccgcgctccccgcgcccctgccggacgccggcgcccgcctccccgactccccgcaggccgtgttcgcgcagctggtggcccgagatgtacagctgaaggaaggacccctgcgctggtacagtgacccgggcctggcagagccccagcacccctcccctgggctgcaccctggctccacagcccagctcaaggaacctccctctcttcttcctccctcagtacagctgaaggaaggacccctgcgctggtacagtgacccgggcctggcaggtgtattcctggggccgggcctgagttatgaccagcacactcgggagctgatggtggtggaacccgggctctactatgttttcttgcacctgaagctgcagcgggtaatgtccagcacgggctccggctctgtctctgctgccctgcacctgcagccacttggcaccgaggctgcagccctggacctgaccttggacctgcctccaccatcctcggaggcccgtgactcagcagctggtttccggggcagcctgctgcacctggacgcaggccagcgcctccgtgttcacttgcgagctgaggcaggggcccaccctgcctggcagctggcacaaggtgccacgatcttgggcctcttcagagtggccaccaaagtccccactggactcccctcgtcatggcccatggacacggggcctgggtccccgcccctggatggagaatga

SEQ ID NO: 27 - DNA, 765 bp, Homo sapiens
  misc_feature 1..765: note = Human 4-1BBL
  source 1..765: mol_type = genomic DNA
atggagtacgccagtgatgcctcgcttgacccggaagccccttggccgcccgcgcctagagcccgagcctgtcgtgtcttaccatgggctttagtcgccggtttgcttctactactattgttagccgccgcgtgtgcggtattcctagcctgtccctgggccgtatcaggtgcgagagcatcacccggatccgcagcgagtccacgacttcgagaaggtcccgaattatcgccagacgatcccgcaggactacttgatttgcgacagggaatgtttgcacaattagtagcacaaaatgtcttacttatcgacggtccactttcatggtattcagatcccggactagccggagtctccttaactggaggtcttagttacaaggaggacacgaaggagttagtagtcgctaaggcgggtgtctattatgtattcttccagttggaactaagacgagttgttgccggtgagggatcgggatcggtatcactagccttgcacttgcagccattgagatcggcagccggtgctgcagccttagccctaacagtcgacttaccacctgctagttctgaggccagaaactccgctttcggatttcaaggacgtttattgcatctttcagcgggacaaagattgggtgtgcatctacatacggaggctcgtgcaagacatgcgtggcagctaacacagggtgctaccgtattgggattgttccgtgttacgccggaaattcccgcaggacttccttcgccccgaagtgaataa

SEQ ID NO: 28 - DNA, 810 bp, synthetic construct
  misc_feature 1..810: note = Human AQP1, amplified from an open reading frame cDNA
  source 1..810: mol_type = other DNA
atggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatag

SEQ ID NO: 29 - DNA, 24 bp, synthetic construct
  misc_feature 1..24: note = DNA fragment encoding a FLAG tag
  source 1..24: mol_type = other DNA
gactacaaagacgacgacgacaaa

SEQ ID NO: 30 - DNA, 6246 bp, synthetic construct
  misc_feature 1..6246: note = Vector 5 (loxP-pEL-TurboFP635-loxP-pEL-IgK-hscAb(CTLA-4)-FLAG; h-scAb(CTLA-4) of SEQ ID NO:17
  variation 972: note = n is a, c, g, or t
  variation 974: note = n is a, c, g, or t
  source 1..6246: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacnnntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaacggacactttattgttgtgggtgctattgttgtgggtccctggttcaacgggtgacatagtgttgacccagagtccaggtactcttagtttaagtccaggagagcgagccactttgtcatgccgagcttcacagtcagtaggttcgtcttacttggcctggtaccaacaaaaaccgggacaggctccgagattacttatttacggtgctttttcccgtgcgacgggtataccagacagattctccggatccggttccggtactgactttaccttgacaatcagtcgtttagagccagaagatttcgccgtctactactgccaacagtacggatcctccccttggactttcggtcaaggaactaaagtagaaataaagagaggtggaggaggtagtggaggtggaggatcgggaggaggaggttcacaagtccaacttgtcgaatcaggaggtggagtggtgcagccaggacgttcactacgtttgtcttgcgcggcgtccggatttacattttcctcctatacgatgcactgggtacgtcaagctcctggtaagggtcttgagtgggtcacctttatctcctacgatggaaacaataagtattacgcggactcagtaaaaggtcgatttactatttcacgagataattctaaaaacacgctttatttgcaaatgaactccttacgtgcagaggatactgcgatttattattgtgcgcgaacaggatggctaggtccttttgattattggggacagggtactcttgttacagtttcatcagataaaactcatacttgcccaccgtgcccagccccggagttgctaggtggaccctccgtattcttgttccctcctaaaccgaaggacacgcttatgatttctagaactcccgaagttacgtgtgttgtggtagatgtttcccatgaggatcccgaggtgaaatttaactggtacgtcgacggagttgaggtgcataacgcgaagacgaaacccagagaagagcagtacaactcgacgtaccgtgttgtatccgtattaacagtactacatcaggactggttgaacggaaaagaatacaaatgcaaggtttcaaataaggctcttccagccccaatagagaaaacaatctctaaagcaaaaggacaaccacgtgagccccaggtatataccttaccgccaagtagagaggagatgaccaaaaatcaagtctccttgacttgcttggtcaagggattttacccgtcggacatcgccgttgaatgggaatccaacggtcagcctgaaaacaactacaaaacaactccaccagttttggattccgacggatcttttttcctatacagtaagctaaccgtagacaaatcgcgatggcaacagggtaacgtgttttcttgttcggtcatgcacgaggctttgcacaaccattacactcaaaagtctctatcgcttagtccaggtaaggactacaaagacgacgacgacaaataattaattaatttttatcgatctaattcaacaatgtctggagcatgc

SEQ ID NO: 31 - DNA, 6378 bp, synthetic construct
  misc_feature 1..6378: note = Vector 6 (loxP-pEL-TurboFP635-loxP-pEL-IgK-mscAb(CTLA-4)-FLAG; m-scAb(CTLA-4) of SEQ ID NO:21
  misc_difference 972: note = n is a, c, g, or t
  misc_difference 974: note = n is a, c, g, or t
  source 1..6378: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacnnntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaaccgacacacttctattatgggtcctacttttgtgggttccaggttcaacaggagacattcgtcgtgctgatatagtaatgactcagactacactttctctacctgtatcgttaggtgaccaagccagtatatcttgtcgttcttctcagtccatcgtgcatagtaatggtaacacctacttagagtggtacctacaaaagccgggtcagtcaccaaagttattaatctacaaggtttcaaaccgattctctggagttcctgacagatttagtggttccggatccggtaccgacttcaccctaaagatttcaagagtggaggcagaagacttgggagtgtattactgtttccagggatctcacgtcccgtacacatttggaggtggaaccaaattagagatcaagagagccgacgcggcgcctactgtgagtggtagtggaggaggaggttcgggtggtggtggttccggaggaggtggttcagaagccaagttgcaagaatcgggacctgttttagtaaagccgggtgcttctgtaaagatgtcttgtaaggcgagtggttatacgtttactgattactacatgaattgggtcaaacaatcacacggaaagagtcttgaatggatcggtgtgattaatccatacaatggtgatacgtcttacaaccagaaatttaagggaaaagctacactaacagtagacaagtcatctagtacagcctacatggagcttaactctttgacctcggaagactctgccgtctactactgcgcgcgttactatggatcctggtttgcttattggggacagggaactctaattactgtatctactgcgaaaaccaccccgccatccgtgtatccattagccccgagatcgtcgcgtggttgtaaaccgtgtatctgcactgttccagaggtttcctcggtgttcatattccctcccaagccgaaggacgttcttactattacccttacgccaaaggtcacttgtgtcgttgttgatatctccaaagacgatcctgaggtacagttttcttggttcgtcgacgatgttgaagtacacacggcgcaaacacaacctcgtgaagagcaattcaattccacttttagatcagtgtccgaattacccatcatgcaccaggactggttaaacggtaaagaattcaaatgtagagtgaactccgctgcgtttccagctccgatcgaaaagaccatctccaagactaaaggtcgacccaaggcgccccaagtctacacgataccaccccccaaagagcagatggccaaggacaaggtgagtttaacgtgtatgataacggacttcttccctgaagatataactgtagagtggcagtggaatggtcagccggcggaaaactataaaaacactcagcctattatggacaccgacggttcatatttcgtgtattccaaacttaacgtgcagaaatctaactgggaagcgggtaatacctttacgtgctcggtcctacatgaaggacttcataatcatcatacagaaaaatctttatctcattcacccggtaaatgagactacaaagacgacgacgacaaataattaattaatttttatcgatctaattcaacaatgtctggattaattaatttttatcgatctaattcaacaatgtctggagcatgc

SEQ ID NO: 32 - DNA, 5343 bp, synthetic construct
  misc_feature 1..5343: note = Vector 7 (loxP-pEL-TurboFP635-loxP-pEL-murine OX40L)
  source 1..5343: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatcccggccgaaaaattgaaattttattttttttttttggaatataaataagctcgaagtcgaccaccatggaaggtgaaggtgtccaacccctagatgagaacctagagaatggatcaagacctcgtttcaaatggaagaaaacactaagattggtggtatccggtataaaaggagcgggaatgctattgtgttttatctacgtgtgtctacaattatcatcctcaccggctaaagaccccccaatacaacgactacgaggtgcagtgactcgttgtgaagacggtcagttatttatttcatcttacaaaaacgaatatcaaacaatggaagttcagaacaactctgtcgttataaagtgtgatggtctttacattatttacttgaaaggttcattctttcaagaggtgaaaatagacttgcatttccgagaagaccacaatccgatctcgataccgatgcttaatgatggtagacgaattgtttttacagtcgtagcgtcattagccttcaaagacaaagtatacctaaccgtgaatgcaccggataccttatgtgagcacctacaaataaacgatggtgaattaattgtagtacaattaacccctggttattgtgcgcctgagggttcctaccattcaacagtgaatcaggttcccttgtgattaattaatttttatcgatctaattcaacaatgtctggacttaag

SEQ ID NO: 33 - DNA, 5292 bp, synthetic construct
  misc_feature 1..5292: note = Vector 8 (loxP-pEL-TurboFP635-loxP-pEL-canine OX40L)
  source 1..5292: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaggtgtacaacccttggaccaaaatgttggaaacacgccaggtcgtcgtttccagaaaaacaaggtgcttctagtcgccgctataatacaaggtcttggattgctactttgctttacctacatttgcttacacttttacgcatcgcaagttcctccacaatatcctccaattcaatctatacgtgtacaatttaccagatgcgagaatgagaagggatgtataatcacaagtccttctaaagatgaaacaatgaaggtgcaagataatagtataattataaattgtgatggattttatttgattagtctaaaaggttacttctcggaagaactatcgttatcgttatattacagaaaaggtcgaggaccgcttttttccctttcaaaagtcacgtcagtagactcgatcggtgtagcataccttgcatttaaagacaaggtatatttcaatgttacaactcatagtacgtcgtacaaagacattcaggtgaatggaggagagttgatcttaatacaccagaatccaggaggattctgtgcgtactgattaattaatttttatcgatctaattcaacaatgtctgga

SEQ ID NO: 34 - DNA, 5292 bp, synthetic construct
  misc_feature 1..5292: note = Vector 9 (loxP-pEL-TurboFP635-loxP-pEL-human OX40L)
  source 1..5292: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaacgagtgcagccgttagaggaaaacgtgggtaatgcagcgagaccgcgatttgaacgaaataagctattattggttgccagtgtcatccaaggtttgggtcttctattgtgcttcacatacatttgtttgcattttagtgcccttcaagtctcgcacagatacccgagaatacagtcaataaaagttcagttcacggagtataagaaagaaaagggttttatcttgaccagtcagaaggaggacgagataatgaaagtccaaaacaattccgtcattattaactgcgacggattctatcttatctctctaaaaggttacttctctcaagaggtgaacatctcactacactaccagaaagacgaagagcctcttttccagctaaaaaaagtgcgttccgtgaactctctaatggttgcatcattaacttacaaagataaagtttacttgaacgtcacaacagataacacatccctagacgattttcacgtcaacggtggtgagcttattcttatccaccagaaccccggagagttttgcgttctatgattaattaatttttatcgatctaattcaacaatgtctgga

SEQ ID NO: 35 - DNA, 5676 bp, synthetic construct
  misc_feature 1..5676: note = Vector 10 (loxP-pEL-TurboFP635-loxP-pEL-murine 4-1BBL)
  source 1..5676: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatcccggccgaaaaattgaaattttattttttttttttggaatataaataagctcgaagtcgaccaccatggatcaacatactttggacgtagaggatactgccgacgcacgtcatcccgccggtacctcctgcccttcggacgccgcgttacttagagatactggtttacttgcagacgcggcgctactatcagacaccgtccgtcccaccaacgcagcgctaccgaccgatgcggcctatcctgctgtgaacgtaagagaccgagaggcggcgtggccgccagctttaaacttttgctcccgacatcccaaattgtatggtctagttgcacttgttttgttgttattgatcgctgcttgcgtccccatatttactagaaccgaacctcgacccgccctaactataactacatccccaaacctaggaacccgtgagaataacgcagaccaggtaaccccagtatcccacatcggttgtccaaacactactcagcagggttccccagtatttgctaaattactagccaagaatcaagcatccttgtgtaacaccaccttaaactggcatagtcaagacggtgccggtagttcgtacctttcgcagggtttacgatacgaggaagacaaaaaagagctagttgttgactcaccgggtttatattatgtattcctagagctaaagttgtcccctacgttcactaatactggtcataaggtacagggttgggtatcacttgtgttgcaagctaagccccaagtggacgacttcgacaacttagctttaactgtcgagttgttcccgtgctcaatggaaaacaaattggtcgacagaagttggtctcaattgttattactaaaagccggtcaccgtctaagtgtgggactacgtgcatatttacacggagcacaagacgcatacagagattgggaattgagttacccaaacaccacgtcctttggtttatttttggtgaaaccggataatccctgggaatgattaattaatttttatcgatctaattcaacaatgtctggacttaag

SEQ ID NO: 36 - DNA, 5637 bp, synthetic construct
  misc_feature 1..5637: note = Vector 11 (loxP-pEL-TurboFP635-loxP-pEL-canine 4-1BBL)
  source 1..5637: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatgcgaccgcgttctgacgcagcaccagatcctgaagctccacgtccacccgcacccccaggacgtgcctgttcgccacttccgtgggcgttatctgcagccatgttactacttgtaggaacttgcgcggcatgcgccctacgtgcctgggtagtccctggtcctagaccacctgcacttcccgcccttcctgctccattacctgatgcaggagccagattgccagattcgcctcaggctgtgtttgcgcaactagttgcgcgtgatgttcaattgaaagaaggacctttaagatggtattcggatccaggtcttgctgagccccagcatccttccccgggattacaccctggatcgaccgcacagttaaaagaacccccttctcttctaccaccctcggtacaactaaaagagggtcctcttcgatggtattctgatcccggacttgccggagtgtttctaggtccaggtttatcatacgaccaacatactagagaacttatggtagtggaacctggtctatactacgtctttcttcatttaaaattacaacgtgtgatgtcatcaactggttcaggttcggtgagtgcggcgcttcacctacaacccttgggtaccgaggcggccgctttggacttaactctagatttaccacctccgtccagtgaagctcgagattccgccgctggatttagaggatctctacttcatcttgatgccggtcagcgtttacgagtccatctaagagctgaagcgggagcacacccagcttggcagctagctcagggtgcaactatccttggactattccgagttgcgacaaaggtcccaactggattaccatcttcgtggccaatggataccggaccgggtagtccaccccttgatggagaatgattaattaatttttatcgatctaattcaacaatgtctgga

SEQ ID NO: 37 - DNA, 5505 bp, synthetic construct
  misc_feature 1..5505: note = Vector 12 (loxP-pEL-TurboFP635-loxP-pEL-human 4-1BBL)
  source 1..5505: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggagtacgccagtgatgcctcgcttgacccggaagccccttggccgcccgcgcctagagcccgagcctgtcgtgtcttaccatgggctttagtcgccggtttgcttctactactattgttagccgccgcgtgtgcggtattcctagcctgtccctgggccgtatcaggtgcgagagcatcacccggatccgcagcgagtccacgacttcgagaaggtcccgaattatcgccagacgatcccgcaggactacttgatttgcgacagggaatgtttgcacaattagtagcacaaaatgtcttacttatcgacggtccactttcatggtattcagatcccggactagccggagtctccttaactggaggtcttagttacaaggaggacacgaaggagttagtagtcgctaaggcgggtgtctattatgtattcttccagttggaactaagacgagttgttgccggtgagggatcgggatcggtatcactagccttgcacttgcagccattgagatcggcagccggtgctgcagccttagccctaacagtcgacttaccacctgctagttctgaggccagaaactccgctttcggatttcaaggacgtttattgcatctttcagcgggacaaagattgggtgtgcatctacatacggaggctcgtgcaagacatgcgtggcagctaacacagggtgctaccgtattgggattgttccgtgttacgccggaaattcccgcaggacttccttcgccccgaagtgaataattaattaatttttatcgatctaattcaacaatgtctgga

SEQ ID NO: 38 - DNA, 7602 bp, synthetic construct
  misc_feature 1..7602: note = Vector 20 (loxP-pEL-TurboFP635-loxP-pL-IgK-scAb(VEGF)-FLAG-pEL-hNIS)
  source 1..7602: mol_type = other DNA
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgttttttttttttttttttttggcatataaataagccgaccaccatggagactgatacccttcttttatgggtcctacttttatgggtgccgggttcaacgggagatgaggtgcagttggttgagtcgggaggtggtttggttcaacctggaggtagtcttcgattatcttgcgcagccagtggtttcactataagtgattattggattcattgggttcgtcaagcccccggtaagggattagaatgggttgcaggaataacaccagccggtggatatacgtattacgccgactccgttaagggacgttttacgatttcagccgacacgtctaaaaacactgcgtaccttcagatgaattctcttagagctgaagatacggcagtgtactactgtgctcgttttgtgtttttcttgccttacgcaatggattactggggacagggaactctagttacggtttcatcgggaggaggtggttctggtggaggtggatccggaggaggtggttcggatattcaaatgacccagtcgccaagttccttatcagcatctgtgggagacagagtgacaatcacttgtagagcttcgcaagatgtatccacggctgtagcttggtatcaacaaaagccaggtaaagctccaaaactattaatatactcagcatcatttctatattctggtgtaccttcccgattctcgggttcgggttctggaaccgatttcaccttgaccatcagttcgttacaaccggaggatttcgccacatattactgccaacaaggatatggtaatccattcacttttggacaaggaacgaaggtagaaatcaagcgagactacaaagacgacgacgacaaataattaattaatttttatcgatctaattcaacaatgtctggaggatccgcatgtctaattcaacaatgaaaaattgaaaaactagcgtctttttttgctcgaagtcgaccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgattaattaatttttatcgatctaattcaacaatgtctggacgatatcatttaaatgcggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 39 - DNA, 6502 bp, synthetic construct
  misc_feature 1..6502: note = Vector 21 (loxP-pEL-TurboFP635-loxP-pL-IgK-scAb(VEGF)-FLAG-pEL-AQP1)
  source 1..6502: mol_type = other DNA
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgttttttttttttttttttttggcatataaataagccgaccaccatggagactgatacccttcttttatgggtcctacttttatgggtgccgggttcaacgggagatgaggtgcagttggttgagtcgggaggtggtttggttcaacctggaggtagtcttcgattatcttgcgcagccagtggtttcactataagtgattattggattcattgggttcgtcaagcccccggtaagggattagaatgggttgcaggaataacaccagccggtggatatacgtattacgccgactccgttaagggacgttttacgatttcagccgacacgtctaaaaacactgcgtaccttcagatgaattctcttagagctgaagatacggcagtgtactactgtgctcgttttgtgtttttcttgccttacgcaatggattactggggacagggaactctagttacggtttcatcgggaggaggtggttctggtggaggtggatccggaggaggtggttcggatattcaaatgacccagtcgccaagttccttatcagcatctgtgggagacagagtgacaatcacttgtagagcttcgcaagatgtatccacggctgtagcttggtatcaacaaaagccaggtaaagctccaaaactattaatatactcagcatcatttctatattctggtgtaccttcccgattctcgggttcgggttctggaaccgatttcaccttgaccatcagttcgttacaaccggaggatttcgccacatattactgccaacaaggatatggtaatccattcacttttggacaaggaacgaaggtagaaatcaagcgagactacaaagacgacgacgacaaataattaattaatttttatcgatctaattcaacaatgtctggaggatccgcatttaaatgcggccgcatgcgcggccgcaaaaattgaaattttattttttttttttggaatataaataagctcgaagtcgaccaccatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagtaattaatttttatcgatctaattcaacaatgtctggacgatatcatttaaatgcggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 40 - DNA, 9174 bp, synthetic construct
  misc_feature 1..9174: note = Vector encoding the Cas9HF cytosolic gene
  source 1..9174: mol_type = other DNA
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcaccatgggacctaagaaaaagaggaaggtggcggccgctaatacgactcactatagggagagccgccaccatggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccgcctttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggagccttgtcgcggaaacttatcaacgggataagagacaagcaaagtggtaaaactattctcgattttctaaagagcgacggcttcgccaataggaactttatggccctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgcgccatcacaaagcatgttgcccagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactaatctagaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 41 - DNA, 23 bp, synthetic construct
  misc_feature 1..23: note = Reverse primer designed to amplify the intergenic region
  source 1..23: mol_type = other DNA
gacgaagaagcaagagattgtgt

SEQ ID NO: 42 - DNA, 19 bp, synthetic construct
  misc_feature 1..19: note = Forward primer designed to amplify the intergenic region
  source 1..19: mol_type = other DNA
accgtttccattaccgcca

SEQ ID NO: 43 - RNA, 20 nt, synthetic construct
  misc_feature 1..20: note = gRNA2 targeting DNA within the 92 bp intergenic area (SEQ ID NO:6)
  source 1..20: mol_type = other RNA
tttgtagttatctgattccc

SEQ ID NO: 44 - DNA, 4583 bp, synthetic construct
  misc_feature 1..4583: note = Vector 22 (loxM3-pEL-eGFP-loxM7)
  source 1..4583: mol_type = other DNA
agtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgataacttcgtatatggtattatatacgaagttataagcttcaattgctgcagactagtcccggggctagcaaaaattgaaattttattttttttttttggaatataaataagctcgaagtcgaccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatttttatcgatctaattcaacaatgtctggaggatccgcatgctggccagaattcgcggccgcaccggtatttaaatcttaagataacttcgtatattctatcttatacgaagttataagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 45 - DNA, 3679 bp, synthetic construct
  misc_feature 1..3679: note = Vector 2 (loxM3-pEL-TurboFP635-loxM7)
  source 1..3679: mol_type = other DNA
cgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgggtaccggttagctcaacagctgacataacttcgtatatggtattatatacgaagttataagcttcaattgctgcagactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaggatccgcatgctggccagaattcgcggccgcaccggtatttaaatcttaagataacttcgtatattctatcttatacgaagttatgctttacgagggttacag

SEQ ID NO: 46 - DNA, 8961 bp, synthetic construct
  misc_feature 1..8961: note = Vector 23 (Lentiviral vector encoding Cre recombinase under control of the CMV promoter)
  source 1..8961: mol_type = other DNA
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgctagcttttaaaagaaaaggggggattggggggtacagtgcaggggaaagaatagtagacataatagcaacagacatacaaactaaagaattacaaaaacaaattacaaaaattcaaaattttactagtgattatcggatcaactttgtatagaaaagttgtagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccaagtttgtacaaaaaagcaggctgccaccatgggcccaaagaagaagagaaaggtttcgaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattagacccagctttcttgtacaaagtggtgataatcgaattccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgggaattcccgcggttcgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctcacgtggccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagagagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 47 - DNA, 4770 bp, synthetic construct
  misc_feature 1..4770: note = Vector 24 (loxM3-pEL-eGFP-pEL-CRE-loxM7)
  source 1..4770: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatataacttcgtatatggtattatatacgaagttatcaattgctgcagactagtcccggggctagcaaaaattgaaattttattttttttttttggaatataaataagctcgaagtcgaccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatttttatcgatctaattcaacaatgtctggaggatccgcatgcggccgcaaaaattgaaattttattttttttttttggaatataaataagctcgaagtcgaccaccatgtccaatcttcttacggtgcatcaaaacctaccggcccttcccgtggatgcaacttcagatgaagttcgaaaaaatcttatggatatgtttagagatcgacaagccttttccgagcatacgtggaagatgttgctttcggtatgcagatcgtgggcagcttggtgcaaattgaacaaccgaaagtggttcccagcagaaccagaggatgtaagagactacctattgtatttacaagcaagaggtttggccgttaaaacgattcaacagcaccttggtcaattgaatatgttacatagacgttcgggtctaccccgtccgagtgacagtaatgctgtatcattggttatgagaagaatccgtaaagagaacgttgatgcaggagaaagagcgaaacaggcacttgcattcgagcgaacggactttgaccagatacgttccctaatggaaaattccgaccgttgtcaagacatcagaaacttggcttttttgggtattgcatacaatacgttgctaagaatagctgaaatagcaagaatccgtgtgaaggatatttcgagaacagacggtggtagaatgttgatacacattggacgtaccaaaacgttggtctccacagcaggtgttgaaaaggcactttcattaggtgttaccaaattagtcgaacgatggatatcagtttcgggtgtggccgatgacccgaacaactatcttttctgccgtgtgcgaaagaatggagtagctgcaccctctgcgacaagtcagttatcgaccagagcgttagagggtatctttgaagcgacacacagattgatatatggagcgaaagatgatagtggacaaagataccttgcatggtcgggacactccgcccgagtgggagccgcccgagatatggcccgtgccggtgtatccatccctgaaatcatgcaggcgggaggttggacgaatgtcaatattgtgatgaactacatacgtaacttagattcggaaactggagcgatggtacgtttgttggaggacggtgactgattaattaatttttatcgatctaattcaacaatgtctggacatgctggccagaattcaccggtatttaaatcttaagataacttcgtatattctatcttatacgaagttatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 48 - DNA, 7705 bp, synthetic construct
  misc_feature 1..7705: note = Vector encoding gRNA2 (SEQ ID NO:43)
  source 1..7705: mol_type = other DNA
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgctagcttttaaaagaaaaggggggattggggggtacagtgcaggggaaagaatagtagacataatagcaacagacatacaaactaaagaattacaaaaacaaattacaaaaattcaaaattttactagtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtttgtagttatctgattcccgttttagagctagaaatagcaagttaaaataaggctagtccgttatcaacttgaaaaagtggcaccgagtcggtgcttttttgttttagagctagaaatagcaagttaaaataaggctagtccgtttttagcgcgtgcgccaattctgcagacaaatggctctagaggtaccgaattccaactttgtatagaaaagttggggttgcgccttttccaaggcagccctgggtttgcgcagggacgcggctgctctgggcgtggttccgggaaacgcagcggcgccgaccctgggtctcgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccaggcaagtttgtacaaaaaagcaggctgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaacccagctttcttgtacaaagtggtggtacccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagagagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 49 - DNA, 34 bp, synthetic construct
  misc_feature 1..34: note = loxM3
  source 1..34: mol_type = other DNA
ataacttcgtatatggtattatatacgaagttat

SEQ ID NO: 50 - DNA, 817 bp, synthetic construct
  misc_feature 1..817: note = DNA encoding enhanced green fluorescent protein (eGFP) flanked by Vaccinia virus early/late promoter upstream (pEL; SEQ ID NO:19) and Vaccinia virus transcription termination signals downstream
  source 1..817: mol_type = other DNA
aaaaattgaaattttattttttttttttggaatataaataagctcgaagtcgaccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatttttatcgatctaattcaacaatgtctgga

SEQ ID NO: 51 - DNA, 34 bp, synthetic construct
  misc_feature 1..34: note = loxM7
  source 1..34: mol_type = other DNA
ataacttcgtatattctatcttatacgaagttat

SEQ ID NO: 52 - DNA, 645 bp, synthetic construct
  misc_feature 1..645: note = DNA fragment in F1L
  source 1..645: mol_type = other DNA
tttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattatt

SEQ ID NO: 53 - DNA, 943 bp, synthetic construct
  misc_feature 1..943: note = loxM7-pEL-eGFP-loxM7-MCS
  source 1..943: mol_type = other DNA
ataacttcgtatattctatcttatacgaagttataagcttaaaaattgaaattttattttttttttttggaatataaataagctcgaagtcgaccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatttttatcgatctaattcaacaatgtctggaggatccataacttcgtatattctatcttatacgaagttatgcatgctggccagaattcgcggccgcaccggtatttaaatcttaag

SEQ ID NO: 54 - DNA, 20 bp, synthetic construct
  misc_feature 1..20: note = Exemplary DNA sequence for gRNA targeting F1L
  source 1..20: mol_type = other DNA
tattcacgcgtgctagtgtt

SEQ ID NO: 55 - DNA, 20 bp, synthetic construct
  misc_feature 1..20: note = Exemplary DNA sequence for gRNA targeting F1L
  source 1..20: mol_type = other DNA
gttccgttgatagataatcg

SEQ ID NO: 56 - DNA, 8431 bp, synthetic construct
  misc_feature 1..8431: note = Vector encoding a gRNA for targeting F1L
  source 1..8431: mol_type = other DNA
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtattcacgcgtgctagtgttgttttagagctagaaatagcaagttaaaataaggctagtccgttatcaacttgaaaaagtggcaccgagtcggtgcttttttgtctagaggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 57 - DNA, 529 bp, synthetic construct
  misc_feature 1..529: note = Homologous left region
  source 1..529: mol_type = other DNA
atggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgta

SEQ ID NO: 58 - DNA, 619 bp, synthetic construct
  misc_feature 1..619: note = Homologous right region
  source 1..619: mol_type = other DNA
ttaacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgat

SEQ ID NO: 59 - DNA, 785 bp, synthetic construct
  misc_feature 1..785: note = B8R fragment
  source 1..785: mol_type = other DNA
ctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaactt

SEQ ID NO: 60 - DNA, 931 bp, synthetic construct
  misc_feature 1..931: note = loxP-pEL-TurboFP635-loxP-MCS
  source 1..931: mol_type = other DNA
ataacttcgtatagcatacattatacgaagttataagcttaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaggatccgcatgcataacttcgtatagcatacattatacgaagttattggccagaattcgcggccgcaccggtatttaaatcttaag

SEQ ID NO: 61 - DNA, 20 bp, synthetic construct
  misc_feature 1..20: note = Exemplary DNA sequence for gRNA targeting B8R
  source 1..20: mol_type = other DNA
ccgactgtaacattaactga

SEQ ID NO: 62 - DNA, 20 bp, synthetic construct
  misc_feature 1..20: note = Exemplary DNA sequence for gRNA targeting B8R
  source 1..20: mol_type = other DNA
tcttatttaactaaatttct

SEQ ID NO: 63 - DNA, 8431 bp, synthetic construct
  misc_feature 1..8431: note = Vector encoding a gRNA for targeting B8R
  source 1..8431: mol_type = other DNA
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtcagttaatgttacagtcgggttttagagctagaaatagcaagttaaaataaggctagtccgttatcaacttgaaaaagtggcaccgagtcggtgcttttttgtctagaggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaagaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 64 - DNA, 624 bp, synthetic construct
  misc_feature 1..624: note = Homologous left region
  source 1..624: mol_type = other DNA
atgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataatttta

SEQ ID NO: 65 - DNA, 624 bp, synthetic construct
  misc_feature 1..624: note = Homologous right region
  source 1..624: mol_type = other DNA
gactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtg

SEQ ID NO: 66 - DNA, 651 bp, synthetic construct
  misc_feature 1..651: note = Homologous left region
  source 1..651: mol_type = other DNA
gttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttgaaacagtatgtaaaagtactcaatctgtactatgtgttaaaaaattctacaagtgacaac

SEQ ID NO: 67 - DNA, 937 bp, synthetic construct
  misc_feature 1..937: note = loxM3-pEL-TagBFP-loxM3-MCS
  source 1..937: mol_type = other DNA
ataacttcgtatatggtattatatacgaagttatactagtcccggggctagcaaaaattgaaattttattttttttttttggaatataaataagctcgaagtcgaccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgattaattaatttttatcgatctaattcaacaatgtctggaaccggtcttaagataacttcgtatatggtattatatacgaagttatggatccgcatgcgatatcatttaaatgcggccgcgagctc

SEQ ID NO: 68 - DNA, 562 bp, synthetic construct
  misc_feature 1..562: note = Homologous right region
  source 1..562: mol_type = other DNA
aattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataa

SEQ ID NO: 69 - DNA, 1955 bp, synthetic construct
  misc_feature 1..1955: note = loxM7-pEL-eGFP-loxM7-pL-scAb(VEGF)
  source 1..1955: mol_type = other DNA
ataacttcgtatattctatcttatacgaagttataagcttaaaaattgaaattttattttttttttttggaatataaataagctcgaagtcgaccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatttttatcgatctaattcaacaatgtctggaggatccataacttcgtatattctatcttatacgaagttatgcatgctggccagaattcgcggccgcaccggtatttataacttcgtatatggtattatatacgaagttataagcttcaattgctgcagactagtcccggggctagcttttttttttttttttttttggcatataaataagccgaccaccatggagactgatacccttcttttatgggtcctacttttatgggtgccgggttcaacgggagatgaggtgcagttggttgagtcgggaggtggtttggttcaacctggaggtagtcttcgattatcttgcgcagccagtggtttcactataagtgattattggattcattgggttcgtcaagcccccggtaagggattagaatgggttgcaggaataacaccagccggtggatatacgtattacgccgactccgttaagggacgttttacgatttcagccgacacgtctaaaaacactgcgtaccttcagatgaattctcttagagctgaagatacggcagtgtactactgtgctcgttttgtgtttttcttgccttacgcaatggattactggggacagggaactctagttacggtttcatcgggaggaggtggttctggtggaggtggatccggaggaggtggttcggatattcaaatgacccagtcgccaagttccttatcagcatctgtgggagacagagtgacaatcacttgtagagcttcgcaagatgtatccacggctgtagcttggtatcaacaaaagccaggtaaagctccaaaactattaatatactcagcatcatttctatattctggtgtaccttcccgattctcgggttcgggttctggaaccgatttcaccttgaccatcagttcgttacaaccggaggatttcgccacatattactgccaacaaggatatggtaatccattcacttttggacaaggaacgaaggtagaaatcaagcgagactacaaagacgacgacgacaaataattaattaatttttatcgatctaattcaacaatgtctggaggatccgaaataacttcgtatatggtattatatacgaagttatatcttaag

SEQ ID NO: 70 - DNA, 199234 bp, synthetic construct
  misc_feature 1..199234: note = ACAM2000 (GenBank Accession No. AY313847)
  source 1..199234: mol_type = other DNA
agagagaaagagaataaaaatatttttgtaaaactttatttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggattgctgaagactggcaggcacatgcatgccaggacgatatattgtttcatgattgctattgattgattactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgatagtatcattctttgctttcgttaactgtttggaggaagaatctttgttattgcatttaatctcgaaattcagagtgcacacctttctcctgtaaagaaacctgaagttgctaccttattaaggacagagaagtatccatcacgaaagacgggatcgcagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtagtgttacacgatcgcatcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcataatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtagaacaacgatttaatcataggtactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattataatattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaacggcgttaatgtttgctccataatctattatcgcgtagatgaatcgcttctcggctcgcatcttagtgtgacttgacttgtaataattgcttttgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggagacgcctgatatgtaggcattcttcattctattaatgtctactctatagcgctttagttccttatgacgaccggcgatatcatactttactttagaaggaaaatcatcatctatgattaaggcgtatctgatacaggcgaataatggttcaggatatagatagcgtatatctctattaaatgcgtcaatcatagtctctagagtgggatggtagctaagtaataaatcaactagcttcgttttgttttctcttctgtaactacttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatttgagatttgacgtatctatgcttactgtatactcctagcggagttaatccttcgttgtttctacaaagtctctcgactccgcgagagagtaacagtcgaacaatcttaatgtctgtatcgcatttattgaagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctatttcacgaaaaatgatgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccttcaactcaccaccaaagagctccgttgcatcagttctgaaagagatgagaagcctgtagagaggccctgcagtttctctatgggtccatctatgagaaacccacaggatgtattcagtcagacaatgtctgacgtcggccacggtattcagggagtccttagtagcgtggcaatgacagggtctgaactgggcacaaggaaaggccattgtaaaggtagacctgtagccgtttatgctaatagagggctttaatttccatttttttaatgggttgtggatgaggaatgagagtgatatcatattgagatacgtagttatgtagaggtgtatttcctatattatttactttcggtttcatattttaccaactctttaataaatttcttttcacgatgcatcttattaaatgacgttttctcataagtggacatatagatgcagaagtaatgaagaaaagtattacctctatcatctgcataattagggtctgctccttttcttaacaacttatacagtacgtagtagtttatcggttttaaatcaagtctagaatatatagtggattaatatatttttatattagctaaagctatctatactatcagaaagcatatcattctcaacttcatcatgagttaaatatttgtgtaatggaatgtgaccatcactgtcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcattaaacatctttgcatcatactcgcatagcatagtttttcataattaatacaatatttaaaagacttattcggaaagtattttaatacatgtatcatcgatggagatccatatgaggagtcacttgtagttcttcagtagtaataacagtgctatcatcgatagtataattatatgtagaaggttcatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagatatatagccagagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaaccccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtacgccgatagtccagtctttggtatcgatagtgtagttattgaactgagaagttaccgtatagtctttttggtcatctctaaacaaggaaactaatacctctacactattgaacgatttatcttccgtaatgggtggaataacgggaatataaagtggactagcgatggatgaagtcacgaatataagacacgctattaatccgtatatcatcattttgatattacttataataacgatttgtttaatttttagtttatactattaattgtaaatgatattattatttttttaagtattatcagctttagtttatactatttgtaatatttagacatagataaacgtgataaaagtctatttgtttatatttattgcggatagcagtatttccctataaaaagtatacgtcctgtgttgtctttaatcatgtacatgaatggatggtttatgtagaccttcgtacgatataccatcgaaaagttagtcataaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctagaataggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcatggaactcgatactatcgctaccgtatattttatttgcggtagctagtgtcgcacaatacggaatatctacgtccatgtcattattgtcatccttcttatcatcgggtgtattctcattcatattctctatatattttgatagttgttcagctgtagaaccagctgctccatgatttagaatagataaagtagataaaatggaaactggagaaatcaaaacattttcatcagggtgttttacgattagttctttaaagatatccatggtatagaccaaacaataacgataacgatatatatcataaataaataatgttaaatttcagtttatgtttgtaccccgtattcatacttaacaaattggtattacataccattaataatgcaagcataaaaaatcgttagtagatgtttctaaatataggttccgtaagcaaagaatataagaatgaagggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcagcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagttattgatctattatatgaaacggatatgtctagaacggcaattgtcttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgatttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatccacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatatcataaataaaaatagtagcacacaactacttcagcaaacattctttttataaatgccatctatcgtagtgaggacacaagtgaacctataatgagcaaatttattagtatcggttacatgaaggactttctgtagagtgacgattctaccatctatggtacgaacggtttcatcttctttgatgccatcacccagatgttctataaacttggtatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaggcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgaggctttccattctccaaaaacaatttgaccaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgtgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaacagagaaatcagtttaggaaaaaaaattatctatctacatcatcacgtctctgtattctacgatagagtgctactttaagatgcgacagatctgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttggatgaatagtatgtcttaataattgttattattttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccattatcccaggctatgtttcgtccatcatcgttgcgcagagtgaataattcttttgtattcggtagttcaaatatataatccatgcatagatcggtaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttgtataatatctctctgatatatttattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggctgccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaaggtttatatattcaatattttttataaaaaaatcatttcgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagttaatgaaacatttgaactcatcgtacaggacgttctcgtacaggacgtaactataaaccggtttatatttgttcaagatagatacaaatccgataacttttttgacgaattctacgggatccactttaaaagtgtcataccgggttctttttatttttttaaacagatcaatggtgtgatgttgattaggtcttttacgaatttgatatagaatagcgttcacatatcctccataatggtcaatcgccatttgttcgtatgtcataaattctttaattatatgacactgtgtattgtttagttcatccttgttcattgttaggaatctatccaaaatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgttttgtattcagatagtacagcgtagtacatagcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcgatagcaatttgttaataagatgcgctaggctcaatgtcttaataagaagtgtaagaggactatctccgaatttgttttgtttattaacatccgttgatggaagtaaaagatctataatgtctacatacttaactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattgtgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatctagggagtttaagattgtacactttattccctaattgaaacgaccaatagtctaattttgcagccgtaatagaatctgtgaaatgggtcatattatcacctattgccaggtacatactaatattagcatccttatacggaaggcgcaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctccgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatctatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctgaaacatcactaatctcattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatatatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttggccgggcggagccgaacattctccgatatccaatttctgtatatctataatattattaacctccgcatacgcattacagttcttttctagcttggatactacactaggtacatcatctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccgggtacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaataatatacagtcttaaataattacgcaatatctcaatagtttcataattgttagctgttttcatcaaggtttgtatcctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctaaatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatttccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaacccacgtaacattagaattaattatcgatagtaatgcatcaacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacactagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgagaacggacatgctacaaaatatgttcgcggctaatcgcgacaacgtggcgtcgagacttttgaactaaaatacaattatatctttttcgatattaataaatccgtgtcgcccgggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactgaacctactttatcatttttttattcatcatcctctggtggttcgtcgttcctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcatacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagtttgagtttctcatgtctctatataaaggtcctattcccgtatatgaagaaaaagtaaatactgaattcattgctaatggatctttctccggtagatatgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcaccatttcgacatctggatttcagatataaaaatctgttttcaccgtgactttcaaaccaattaatgcaccgaacatccatttctagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcaatcaatgtgtcaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccaataccattaaagaattcttatgatataaggaaacagcttttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtggtagttttctcatcacttagaacagatttaacaatttctataaagtctgtcaaatcatctttcggagaacccatatatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggttttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgagttcccatagctggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcaaaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatttttggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctaatacgtcattaactttattgggtattccgtatggatttggtcataatagaatgtattgttttaaattggtagctgaatgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctgatctgaaaaataatctagtaaaactttctagttatcatgtagtaagtgtcgattgtaacaaggaactgatgcctattaggacagatactactatttgtctaagtatagatcaaaagaaatcttatgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgcggggttaatttcacaactttactgtttttgaactgttcaaaatatagcatcgatccatgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggcgatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcagctctagctaccaccgcaatagatcctgttagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatattatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtattaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccctgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtattagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggactgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatttttgtccttaagactataggtgtcccatcagcatgtagacaaaatgaagatccaagattcgtagaagcatttaaatgcgacgagttaaaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatataatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcaaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactacaatacgaaattgcaaaatatgctctagatactgcaaaacttaaatgttacggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaatgcgatggtcttggataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatacaatatcttcggtatcttgacgcaatctagtatacatagagttaagagaaattagagtttgtacattgagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttttcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctagccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtattatcaaagttaagatctgggtatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaataatagggttagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggattcggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataacttagttcacggaaatatcgctatgattggtgtgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggaggatatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaacagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttattgatgtgatcaatttccaacagaataattagagcagcaggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaatccaaaatgtatatgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatatcatgatatacctgtgacccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagagataactataaatggagatctagatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagcttcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacccagcaaacgattggtaacatcgtttacaaacgacatactatatgtaaacaatctgtcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatagagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacgaaggtggtccatcatcgttgtctagtcatagatggtcgacgtttctcaaagtcgaattagaatgtgacatcgacggaagaagttatagataaattattcattctaaaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggcgttaaatggttcgatataaaggagaaggaaaatgaacatcgggaatatagaatatacttcataaaagaaaattctatatattcattcgatacaaaaactaaacaaactcgcagtgcacaagtcaatgcacaactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaaatatatttgtagtacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcaccatatttatggatttcggattcacacgttgtttgtctgaggtgttcgtctagtgttgcttctacataaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggacgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaaatacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccacttataatatcaaactacttattctattttactaaataatggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatgattaaaattaacaaggatcccaaaaaaattccagagtggttggtagttaataaaatctatattcccgattttgtagtagaggatccaaaacaatctcagatatgggaaatttcaggagcagagtttacatcttccaagtcacatacagcgaatggaatatcgattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaaaagttaagaacgttcacatcgacggacaatctaaaaacaatacagtgattgcagatttgccatatctggataatgctgtatcggatgtatgcaaatcgatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttttggtgataaatttacggtgactactaggagggaaaatgaagaaaaaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaaagtttaaaaaaaagattttgttattgtagtatatgataatatcaaaaagatggatataaagaatttgctgactgtatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatttataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcagcgcataataaattatatgtaggaggaggaatatctgatgatgttcaaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattctattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaagcaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttaatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtaaatcagttaaatttggtaattctattaattgttaaacatatacatctgtttcagctaagcaactaagaacacgtatacggcagcagcttccttctatactctcatcttttaccaagggtggatatttgttcattggagttgataataatacacacaaagtaattggattcacggtgggttacgactacctcagactggtagagaatgatatagaaaagcatatcaaaagactttgtgttgtgtatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataaacattattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacatttacatgtgatcagggatatcattctttggatccaaatgctgtctgcgaaacagataaatggaaatacgaaaatccatgcaagaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggcaaaattcttttcgttggtagatattgctctccaacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaacatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctattatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgttaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcgtttattaatatcgggaaatgtataaactaaaacattgcccggaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcgatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctatccaactcattatagataacaaagaaaattccccgtataccatcgattgtttattgtatatacttagatatattgtagataagaatgtgataagatcgttggtggatcaacttccatctctacctatcttcaatataaaatcatttgagaaattcatatcctactgtatacttttagatgacacattttacaataggcacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataaaaatagaaactataatcatataatagtgtaggttggtagtattgctcttgtgactagagactttagttaaggtactgtaaaaatagaaactataatcatataatagtgtaggttggtagtagggtactcgtgattaattttattgttaaacttgtccttaagtcttattaatatgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaaacactaaattatttttattaataattgtacaagtttttgacatgatatttaatgacattagttgtgtgggtgtatagagttcacagtagctcattcagtcaaaatgtttgactatttggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattagaagaatacacaaatagtagacatgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatagaaaatggctgcagtgttctttatgaggacgagtactgatacgcgtatgatgattatcaactacgaaattgcggtaccgtattgcatctgtattcaaagtcggatacgagagcatatgtgcgtccggaagttgttaaatgtctaattaatcacggaatcaagccgtcttttatagataaaaactattgtacagctcttcaatattatattaagtcatctcatatagatatagacatcgttaaattgttaatgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcgatgatggagagatcccgattggacacctatgtaaatccaactatgaatgttataatttttacacttatacatacaaaaagggtctttgtgacatgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctaaaaacattgaactgctgaaaatgctattatgtcataaacctacattagattatgtgattgattcattgagagaaatatctaacatcgtagataactactatgctataaaacaatgtattaaatatgccatgattatagatgactgtacatcgtctaagattccagagtccataagtcaacgctataatgattatatagatctttgcaattaagaattgaatgagatgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccaacgcaatagtgaaacatgatagaatacataaaaccatagaatcagttgatgataatacctacatttctaatcttccgtataccatcaaatacaaaatattcgagcaacaataagtattttttatacctttaaaattgataaataaattttttctagtgatattttggcaagatgagaatcctatttctcatcgccttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggataccaagtttatagaacatctgggtgatggcatcaaagaagatgaaaccgttcgtaccatagatggtagaatcgtcactctacagaaagtccttcatgtaaccgatactaataaatttgctcattataggttcacttgtgtcctcactacgatagatggcatttataaaaagaatgtttgctgaagtagttgtgtgctactatttttatttatgatataatctaaatgcaattgtcttgagaatccatccaatacggcagattatattagaaacaacgaattgaattgaatttaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatacatgttatgcaaaatatatgattacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtataggtattattagctatgtaccaatttaccaaccttcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtggatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaatcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaagacaattgccgttctagacatatccgtttcatataatagatcaataactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacagaaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgctgaaataaaaaatttttgtataatatctagaggtagaggtattgtttagataaatacaaataacatagatacatcgcatatttagcatttttataaatatacataagacatacactttatacatttttgtaaaaatactcataaaaaaaatttataaaaattatggcacaaccatatcttgtagaggtagtttagttcgtcgagtgaacctataaacagataatagacaacacataataataatgcctactaatacaagcataataccgggagatgggatatatgacgttgtagtgtttggtttttctgaacgttgatagtctactaatactacatgctgacatctaatgcctgtataaccatgagagcatctacaatacataccgtcgatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagatatttcatcgacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattacccttcattcttatattctttgcttacggaacctatatttagaaacatctactaacgattttttatgcttgcattattaatggtatgtaataccaatttgttaagtatgaatacggggtacaaacataaactgaaatttaacattatttatttatgatatatatcgttatcgttattgtttggtctataccatggatatctttaaagaactaatcgtaaaacaccctgatgaaaatgttttgatttctccagtttccattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtacctattctagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgacagtgatggtcacattccattacacaaatatttaactcatgatgaagttgagaatgatatgctttctgatagtatagatagctttagctaatataaaaatatattaatccactatatattctagacttgatttaaaaccgataaactactacgtactgtataagttgttaagaaaaggagcagaccctaattatgcagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgccgttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatattataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaattatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagatgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgcgatcccgtctttcgtgatggatacttctctgtccttaataaggtagcaacttcaggtttctttacaggagaaaggtgtgcactctgaatttcgagattaaatgcaataacaaagattcttcctccaaacagttaacgaaagcaaagaatgatactatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtaatcaatcaatagcaatcatgaaacaatatatcgtcctggcatgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagtattacaaaaatatttttatactctttctctctatgatggtctcataaaaaaagtattacaacaatatgattatgctcttactctctatgatggtctcataacataagtttacaacaatatgatgatctcatacctctgg

SEQ ID NO: 71 - DNA, 199037 bp, synthetic construct
  misc_feature 1..199037: note = ACAM2000 sequence
  source 1..199037: mol_type = other DNA
aaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggattgctgaagactggcaggcacatgcatgccaggacgatatattgtttcatgattgctattgattgattactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgatagtatcattctttgctttcgttaactgtttggaggaagaatctttgttattgcatttaatctcgaaattcagagtgcacacctttctcctgtaaagaaacctgaagttgctaccttattaaggacagagaagtatccatcacgaaagacgggatcgcagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtagtgttacacgatcgcatcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcataatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtagaacaacgatttaatcataggtactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattataatattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaacggcgttaatgtttgctccataatctattatcgcgtagatgaatcgcttctcggctcgcatcttagtgtgacttgacttgtaataattgcttttgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggagacgcctgatatgtaggcattcttcattctattaatgtctactctatagcgctttagttccttatgacgaccggcgatatcatactttactttagaaggaaaatcatcatctatgattaaggcgtatctgatacaggcgaataatggttcaggatatagatagcgtatatctctattaaatgcgtcaatcatagtctctagagtgggatggtagctaagtaataaatcaactagcttcgttttgttttctcttctgtaactacttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatttgagatttgacgtatctatgcttactgtatactcctagcggagttaatccttcgttgtttctacaaagtctctcgactccgcgagagagtaacagtcgaacaatcttaatgtctgtatcgcatttattgaagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctatttcacgaaaaatgatgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccttcaactcaccaccaaagagctccgttgcatcagttctgaaagagatgagaagcctgtagagaggccctgcagtttctctatgggtccatctatgagaaacccacaggatgtattcagtcagacaatgtctgacgtcggccacggtattcagggagtccttagtagcgtggcaatgacagggtctgaactgggcacaaggaaaggccattgtaaaggtagacctgtagccgtttatgctaatagagggctttaatttccatttttttaatgggttgtggatgaggaatgagagtgatatcatattgagatacgtagttatgtagaggtgtatttcctatattatttactttcggtttcatattttaccaactctttaataaatttcttttcacgatgcatcttattaaatgacgttttctcataagtggacatatagatgcagaagtaatgaagaaaagtattacctctatcatctgcataattagggtctgctccttttcttaacaacttatacagtacgtagtagtttatcggttttaaatcaagtctagaatatatagtggattaatatatttttatattagctaaagctatctatactatcagaaagcatatcattctcaacttcatcatgagttaaatatttgtgtaatggaatgtgaccatcactgtcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcattaaacatctttgcatcatactcgcatagcatagtttttcataattaatacaatatttaaaagacttattcggaaagtattttaatacatgtatcatcgatggagatccatatgaggagtcacttgtagttcttcagtagtaataacagtgctatcatcgatagtataattatatgtagaaggttcatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagatatatagccagagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaaccccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtacgccgatagtccagtctttggtatcgatagtgtagttattgaactgagaagttaccgtatagtctttttggtcatctctaaacaaggaaactaatacctctacactattgaacgatttatcttccgtaatgggtggaataacgggaatataaagtggactagcgatggatgaagtcacgaatataagacacgctattaatccgtatatcatcattttgatattacttataataacgatttgtttaatttttagtttatactattaattgtaaatgatattattatttttttaagtattatcagctttagtttatactatttgtaatatttagacatagataaacgtgataaaagtctatttgtttatatttattgcggatagcagtatttccctataaaaagtatacgtcctgtgttgtctttaatcatgtacatgaatggatggtttatgtagaccttcgtacgatataccatcgaaaagttagtcataaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctagaataggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcatggaactcgatactatcgctaccgtatattttatttgcggtagctagtgtcgcacaatacggaatatctacgtccatgtcattattgtcatccttcttatcatcgggtgtattctcattcatattctctatatattttgatagttgttcagctgtagaaccagctgctccatgatttagaatagataaagtagataaaatggaaactggagaaatcaaaacattttcatcagggtgttttacgattagttctttaaagatatccatggtatagaccaaacaataacgataacgatatatatcataaataaataatgttaaatttcagtttatgtttgtaccccgtattcatacttaacaaattggtattacataccattaataatgcaagcataaaaaatcgttagtagatgtttctaaatataggttccgtaagcaaagaatataagaatgaagggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcagcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagttattgatctattatatgaaacggatatgtctagaacggcaattgtcttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgatttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatccacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatatcataaataaaaatagtagcacacaactacttcagcaaacattctttttataaatgccatctatcgtagtgaggacacaagtgaacctataatgagcaaatttattagtatcggttacatgaaggactttctgtagagtgacgattctaccatctatggtacgaacggtttcatcttctttgatgccatcacccagatgttctataaacttggtatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaggcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgaggctttccattctccaaaaacaatttgaccaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgtgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaacagagaaatcagtttaggaaaaaaaattatctatctacatcatcacgtctctgtattctacgatagagtgctactttaagatgcgacagatctgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttggatgaatagtatgtcttaataattgttattattttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccattatcccaggctatgtttcgtccatcatcgttgcgcagagtgaataattcttttgtattcggtagttcaaatatataatccatgcatagatcggtaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttgtataatatctctctgatatatttattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggctgccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaaggtttatatattcaatattttttataaaaaaatcatttcgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagttaatgaaacatttgaactcatcgtacaggacgttctcgtacaggacgtaactataaaccggtttatatttgttcaagatagatacaaatccgataacttttttgacgaattctacgggatccactttaaaagtgtcataccgggttctttttatttttttaaacagatcaatggtgtgatgttgattaggtcttttacgaatttgatatagaatagcgttcacatatcctccataatggtcaatcgccatttgttcgtatgtcataaattctttaattatatgacactgtgtattgtttagttcatccttgttcattgttaggaatctatccaaaatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgttttgtattcagatagtacagcgtagtacatagcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcgatagcaatttgttaataagatgcgctaggctcaatgtcttaataagaagtgtaagaggactatctccgaatttgttttgtttattaacatccgttgatggaagtaaaagatctataatgtctacatacttaactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattgtgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatctagggagtttaagattgtacactttattccctaattgaaacgaccaatagtctaattttgcagccgtaatagaatctgtgaaatgggtcatattatcacctattgccaggtacatactaatattagcatccttatacggaaggcgcaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctccgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatctatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctgaaacatcactaatctcattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatatatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttggccgggcggagccgaacattctccgatatccaatttctgtatatctataatattattaacctccgcatacgcattacagttcttttctagcttggatactacactaggtacatcatctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccgggtacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaataatatacagtcttaaataattacgcaatatctcaatagtttcataattgttagctgttttcatcaaggtttgtatcctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctaaatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatttccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaacccacgtaacattagaattaattatcgatagtaatgcatcaacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacactagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgagaacggacatgctacaaaatatgttcgcggctaatcgcgacaacgtggcgtcgagacttttgaactaaaatacaattatatctttttcgatattaataaatccgtgtcgcccgggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactgaacctactttatcatttttttattcatcatcctctggtggttcgtcgttcctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcatacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagtttgagtttctcatgtctctatataaaggtcctattcccgtatatgaagaaaaagtaaatactgaattcattgctaatggatctttctccggtagatatgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcaccatttcgacatctggatttcagatataaaaatctgttttcaccgtgactttcaaaccaattaatgcaccgaacatccatttctagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcaatcaatgtgtcaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccaataccattaaagaattcttatgatataaggaaacagcttttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtggtagttttctcatcacttagaacagatttaacaatttctataaagtctgtcaaatcatctttcggagaacccatatatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggttttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgagttcccatagctggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcaaaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatttttggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctaatacgtcattaactttattgggtattccgtatggatttggtcataatagaatgtattgttttaaattggtagctgaatgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctgatctgaaaaataatctagtaaaactttctagttatcatgtagtaagtgtcgattgtaacaaggaactgatgcctattaggacagatactactatttgtctaagtatagatcaaaagaaatcttatgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgcggggttaatttcacaactttactgtttttgaactgttcaaaatatagcatcgatccatgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggcgatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcagctctagctaccaccgcaatagatcctgttagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatattatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtattaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccctgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtattagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggactgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatttttgtccttaagactataggtgtcccatcagcatgtagacaaaatgaagatccaagattcgtagaagcatttaaatgcgacgagttaaaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatataatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcaaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactacaatacgaaattgcaaaatatgctctagatactgcaaaacttaaatgttacggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaatgcgatggtcttggataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatacaatatcttcggtatcttgacgcaatctagtatacatagagttaagagaaattagagtttgtacattgagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttttcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctagccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtattatcaaagttaagatctgggtatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaataatagggttagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggattcggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataacttagttcacggaaatatcgctatgattggtgtgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggaggatatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaacagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttattgatgtgatcaatttccaacagaataattagagcagcaggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaatccaaaatgtatatgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatatcatgatatacctgtgacccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagagataactataaatggagatctagatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagcttcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacccagcaaacgattggtaacatcgtttacaaacgacatactatatgtaaacaatctgtcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatagagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacgaaggtggtccatcatcgttgtctagtcatagatggtcgacgtttctcaaagtcgaattagaatgtgacatcgacggaagaagttatagataaattattcattctaaaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggcgttaaatggttcgatataaaggagaaggaaaatgaacatcgggaatatagaatatacttcataaaagaaaattctatatattcattcgatacaaaaactaaacaaactcgcagtgcacaagtcaatgcacaactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaaatatatttgtagtacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcaccatatttatggatttcggattcacacgttgtttgtctgaggtgttcgtctagtgttgcttctacataaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggacgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaaatacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccacttataatatcaaactacttattctattttactaaataatggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatgattaaaattaacaaggatcccaaaaaaattccagagtggttggtagttaataaaatctatattcccgattttgtagtagaggatccaaaacaatctcagatatgggaaatttcaggagcagagtttacatcttccaagtcacatacagcgaatggaatatcgattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaaaagttaagaacgttcacatcgacggacaatctaaaaacaatacagtgattgcagatttgccatatctggataatgctgtatcggatgtatgcaaatcgatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttttggtgataaatttacggtgactactaggagggaaaatgaagaaaaaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaaagtttaaaaaaaagattttgttattgtagtatatgataatatcaaaaagatggatataaagaatttgctgactgtatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatttataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcagcgcataataaattatatgtaggaggaggaatatctgatgatgttcaaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattctattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaagcaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttaatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtaaatcagttaaatttggtaattctattaattgttaaacatatacatctgtttcagctaagcaactaagaacacgtatacggcagcagcttccttctatactctcatcttttaccaagggtggatatttgttcattggagttgataataatacacacaaagtaattggattcacggtgggttacgactacctcagactggtagagaatgatatagaaaagcatatcaaaagactttgtgttgtgtatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataaacattattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacatttacatgtgatcagggatatcattctttggatccaaatgctgtctgcgaaacagataaatggaaatacgaaaatccatgcaagaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggcaaaattcttttcgttggtagatattgctctccaacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaacatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctattatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgttaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcgtttattaatatcgggaaatgtataaactaaaacattgcccggaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcgatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctatccaactcattatagataacaaagaaaattccccgtataccatcgattgtttattgtatatacttagatatattgtagataagaatgtgataagatcgttggtggatcaacttccatctctacctatcttcaatataaaatcatttgagaaattcatatcctactgtatacttttagatgacacattttacaataggcacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataaaaatagaaactataatcatataatagtgtaggttggtagtattgctcttgtgactagagactttagttaaggtactgtaaaaatagaaactataatcatataatagtgtaggttggtagtagggtactcgtgattaattttattgttaaacttgtccttaagtcttattaatatgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaaacactaaattatttttattaataattgtacaagtttttgacatgatatttaatgacattagttgtgtgggtgtatagagttcacagtagctcattcagtcaaaatgtttgactatttggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattagaagaatacacaaatagtagacatgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatagaaaatggctgcagtgttctttatgaggacgagtactgatacgcgtatgatgattatcaactacgaaattgcggtaccgtattgcatctgtattcaaagtcggatacgagagcatatgtgcgtccggaagttgttaaatgtctaattaatcacggaatcaagccgtcttttatagataaaaactattgtacagctcttcaatattatattaagtcatctcatatagatatagacatcgttaaattgttaatgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcgatgatggagagatcccgattggacacctatgtaaatccaactatgaatgttataatttttacacttatacatacaaaaagggtctttgtgacatgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctaaaaacattgaactgctgaaaatgctattatgtcataaacctacattagattatgtgattgattcattgagagaaatatctaacatcgtagataactactatgctataaaacaatgtattaaatatgccatgattatagatgactgtacatcgtctaagattccagagtccataagtcaacgctataatgattatatagatctttgcaattaagaattgaatgagatgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccaacgcaatagtgaaacatgatagaatacataaaaccatagaatcagttgatgataatacctacatttctaatcttccgtataccatcaaatacaaaatattcgagcaacaataagtattttttatacctttaaaattgataaataaattttttctagtgatattttggcaagatgagaatcctatttctcatcgccttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggataccaagtttatagaacatctgggtgatggcatcaaagaagatgaaaccgttcgtaccatagatggtagaatcgtcactctacagaaagtccttcatgtaaccgatactaataaatttgctcattataggttcacttgtgtcctcactacgatagatggcatttataaaaagaatgtttgctgaagtagttgtgtgctactatttttatttatgatataatctaaatgcaattgtcttgagaatccatccaatacggcagattatattagaaacaacgaattgaattgaatttaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatacatgttatgcaaaatatatgattacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtataggtattattagctatgtaccaatttaccaaccttcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtggatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaatcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaagacaattgccgttctagacatatccgtttcatataatagatcaataactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacagaaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgctgaaataaaaaatttttgtataatatctagaggtagaggtattgtttagataaatacaaataacatagatacatcgcatatttagcatttttataaatatacataagacatacactttatacatttttgtaaaaatactcataaaaaaaatttataaaaattatggcacaaccatatcttgtagaggtagtttagttcgtcgagtgaacctataaacagataatagacaacacataataataatgcctactaatacaagcataataccgggagatgggatatatgacgttgtagtgtttggtttttctgaacgttgatagtctactaatactacatgctgacatctaatgcctgtataaccatgagagcatctacaatacataccgtcgatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagatatttcatcgacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattacccttcattcttatattctttgcttacggaacctatatttagaaacatctactaacgattttttatgcttgcattattaatggtatgtaataccaatttgttaagtatgaatacggggtacaaacataaactgaaatttaacattatttatttatgatatatatcgttatcgttattgtttggtctataccatggatatctttaaagaactaatcgtaaaacaccctgatgaaaatgttttgatttctccagtttccattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtacctattctagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgacagtgatggtcacattccattacacaaatatttaactcatgatgaagttgagaatgatatgctttctgatagtatagatagctttagctaatataaaaatatattaatccactatatattctagacttgatttaaaaccgataaactactacgtactgtataagttgttaagaaaaggagcagaccctaattatgcagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgccgttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatattataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaattatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagatgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgcgatcccgtctttcgtgatggatacttctctgtccttaataaggtagcaacttcaggtttctttacaggagaaaggtgtgcactctgaatttcgagattaaatgcaataacaaagattcttcctccaaacagttaacgaaagcaaagaatgatactatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtaatcaatcaatagcaatcatgaaacaatatatcgtcctggcatgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttt

SEQ ID NO: 72 - DNA, 2686 bp, synthetic construct
  misc_feature 1..2686: note = pUC18 cloning vector
  source 1..2686: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaaagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 73 - DNA, 2710 bp, synthetic construct
  misc_feature 1..2710: note = pUC57 cloning vector
  source 1..2710: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 74 - DNA, 50 bp, synthetic construct
  misc_feature 1..50: note = pEL promoter
  source 1..50: mol_type = other DNA
aaaaattgaaattttattttttttttttggaatataaataagctcgaagt

SEQ ID NO: 75 - DNA, 34 bp, synthetic construct
  misc_feature 1..34: note = loxP
  source 1..34: mol_type = other DNA
ataacttcgtatagcatacattatacgaagttat

SEQ ID NO: 76 - DNA, 63 bp, synthetic construct
  misc_feature 1..63: note = IgK sequence
  source 1..63: mol_type = other DNA
atggaaaccgacacacttctattatgggtcctacttttgtgggttccaggttcaacaggagac

SEQ ID NO: 77 - DNA, 1338 bp, synthetic construct
  misc_feature 1..1338: note = Heavy chain of scAb(VEGFR-2)
  source 1..1338: mol_type = other DNA
gaggttcaacttgtacaatcgggaggaggactagtgaagcctggaggttcccttagactaagttgcgcagctagtggttttacattctcgtcctactcaatgaactgggtccgtcaggcgcccggtaagggacttgagtgggtatccagtatctcatcgtcttcttcgtatatttattatgctgattcagtaaagggtcgttttacgatatcgagagataacgccaagaattctttataccttcagatgaattcgttgcgagctgaagacaccgcggtttattattgtgcgcgtgttactgatgcgtttgatatatggggacaaggaacaatggtaactgtttcatctgcctctacaaaaggtccttcagtactacctcttgcgcctagttctaaatccacttccggaggtacagcggctttaggttgcctagtaaaggactactttccagagcctgtaactgtttcgtggaattccggagccctaacgtccggagtgcatactttccccgcggttttgcaatcatctggtctatattctctttcttccgtagtcaccgtcccgtcctcgtcactaggtacccaaacatacatttgtaacgttaaccataaaccgtctaacactaaggttgataaaagagtggaacccaagtcgtgcgacaagacccatacgtgccccccctgcccggcccctgaactattgggtggacccagtgttttcctattcccacctaagccgaaagatactttgatgatctcaagaactcccgaagttacatgcgttgtcgttgacgtctcgcacgaggacccagaagttaaatttaattggtacgtagatggtgtggaggtccataatgcaaaaactaaacccagagaggaacagtataacagtacatatcgagtcgtgtcagtcttgacagttttacatcaagattggttaaatggaaaggaatataagtgtaaggtgagtaacaaagcgttaccggcgccgattgaaaagaccatttcgaaagccaagggacaaccaagagaaccgcaggtgtacaccctaccgccgtcccgagaagaaatgacaaagaaccaagtcagtctaacttgtttggttaaaggattttatccaagtgatatagcggttgaatgggagagtaatggtcaaccggaaaacaattataagacgactccccccgtactagactcggacggttctttctttttgtattcaaaattgaccgttgacaagagtcgatggcagcagggtaatgtgttctcttgttccgttatgcatgaggcacttcataatcactacacgcagaagagtctttcattaagtccgggtaag

SEQ ID NO: 78 - DNA, 45 bp, synthetic construct
  misc_feature 1..45: note = Linker
  source 1..45: mol_type = other DNA
ggaggaggtggttctggtggaggtggatccggaggaggtggttcg

SEQ ID NO: 79 - DNA, 642 bp, synthetic construct
  misc_feature 1..642: note = Light chain of scAb(VEGFR-2)
  source 1..642: mol_type = other DNA
gacatccagatgactcagtcccctagttccgtgtcagcgtccattggagatagagtaacgattacatgcagagcatcgcaaggtattgataactggttaggttggtatcaacaaaagccgggaaaggctcctaagctattgatatatgatgcatcaaatctagatacgggagtgccatcacgtttctcaggatccggatctggtacatatttcactctaacaataagttcattgcaagcggaggactttgccgtatacttttgtcagcaagcgaaggcctttccacctacatttggtggtggtacaaaagtagacattaagcgaacggtggcggcccctagtgtgttcatctttccaccctctgacgaacaattgaaatcaggaactgcatctgtagtctgcttattgaataatttttacccaagagaagccaaggtccaatggaaggttgacaacgccctacaatcgggtaactcccaagagtcagtgaccgagcaagattccaaggatagtacctattctctttcgtctaccctaaccctttctaaagccgactatgaaaaacataaagtttacgcatgcgaagtcacacaccaaggactatcctccccggtcactaagtccttcaaccgaggagaatgc

SEQ ID NO: 80 - DNA, 39 bp, synthetic construct
  misc_feature 1..39: note = Terminator
  source 1..39: mol_type = other DNA
ttaattaatttttatcgatctaattcaacaatgtctgga

SEQ ID NO: 81 - DNA, 6906 bp, synthetic construct
  misc_feature 1..6906: note loxP-pEL-TurboFP635-loxP-pEL-IgK-scAb(VEGFR-2)-FLAG-termina tor vector sequence
  variation 972: note = n is a, c, g, or t
  variation 974: note = n is a, c, g, or t
  source 1..6906: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacnnntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaaccgacacacttctattatgggtcctacttttgtgggttccaggttcaacaggagacgaggttcaacttgtacaatcgggaggaggactagtgaagcctggaggttcccttagactaagttgcgcagctagtggttttacattctcgtcctactcaatgaactgggtccgtcaggcgcccggtaagggacttgagtgggtatccagtatctcatcgtcttcttcgtatatttattatgctgattcagtaaagggtcgttttacgatatcgagagataacgccaagaattctttataccttcagatgaattcgttgcgagctgaagacaccgcggtttattattgtgcgcgtgttactgatgcgtttgatatatggggacaaggaacaatggtaactgtttcatctgcctctacaaaaggtccttcagtactacctcttgcgcctagttctaaatccacttccggaggtacagcggctttaggttgcctagtaaaggactactttccagagcctgtaactgtttcgtggaattccggagccctaacgtccggagtgcatactttccccgcggttttgcaatcatctggtctatattctctttcttccgtagtcaccgtcccgtcctcgtcactaggtacccaaacatacatttgtaacgttaaccataaaccgtctaacactaaggttgataaaagagtggaacccaagtcgtgcgacaagacccatacgtgccccccctgcccggcccctgaactattgggtggacccagtgttttcctattcccacctaagccgaaagatactttgatgatctcaagaactcccgaagttacatgcgttgtcgttgacgtctcgcacgaggacccagaagttaaatttaattggtacgtagatggtgtggaggtccataatgcaaaaactaaacccagagaggaacagtataacagtacatatcgagtcgtgtcagtcttgacagttttacatcaagattggttaaatggaaaggaatataagtgtaaggtgagtaacaaagcgttaccggcgccgattgaaaagaccatttcgaaagccaagggacaaccaagagaaccgcaggtgtacaccctaccgccgtcccgagaagaaatgacaaagaaccaagtcagtctaacttgtttggttaaaggattttatccaagtgatatagcggttgaatgggagagtaatggtcaaccggaaaacaattataagacgactccccccgtactagactcggacggttctttctttttgtattcaaaattgaccgttgacaagagtcgatggcagcagggtaatgtgttctcttgttccgttatgcatgaggcacttcataatcactacacgcagaagagtctttcattaagtccgggtaagggaggaggtggttctggtggaggtggatccggaggaggtggttcggacatccagatgactcagtcccctagttccgtgtcagcgtccattggagatagagtaacgattacatgcagagcatcgcaaggtattgataactggttaggttggtatcaacaaaagccgggaaaggctcctaagctattgatatatgatgcatcaaatctagatacgggagtgccatcacgtttctcaggatccggatctggtacatatttcactctaacaataagttcattgcaagcggaggactttgccgtatacttttgtcagcaagcgaaggcctttccacctacatttggtggtggtacaaaagtagacattaagcgaacggtggcggcccctagtgtgttcatctttccaccctctgacgaacaattgaaatcaggaactgcatctgtagtctgcttattgaataatttttacccaagagaagccaaggtccaatggaaggttgacaacgccctacaatcgggtaactcccaagagtcagtgaccgagcaagattccaaggatagtacctattctctttcgtctaccctaaccctttctaaagccgactatgaaaaacataaagtttacgcatgcgaagtcacacaccaaggactatcctccccggtcactaagtccttcaaccgaggagaatgcgactacaaagacgacgacgacaaataattaattaatttttatcgatctaattcaacaatgtctggattaattaatttttatcgatctaattcaacaatgtctggagcatgc

SEQ ID NO: 82 - DNA, 1293 bp, synthetic construct
  misc_feature 1..1293: note = scAb(VEGF-A fusion protein)
  source 1..1293: mol_type = other DNA
agcgacactggacgaccgttcgttgagatgtattcggagataccggagataatccacatgactgaaggtcgagagttggtcattccgtgccgtgtgactagtccgaatattactgttacgcttaagaagttccctcttgatactttaatcccagacggtaagcgaatcatttgggactcccgaaagggtttcataatatccaatgctacatacaaagaaataggactattgacgtgtgaggccaccgtcaacggtcacctatacaagaccaattacttgacccatcgacagacgaatacgattattgatgtcgtactttcaccttcacatggtattgagttatccgtaggagagaaactagtcttaaattgtactgctcgaacggaattgaacgttggtatagatttcaactgggagtacccgagttcaaaacatcagcacaaaaagttagtcaaccgtgacttaaaaacccagagtggatcggaaatgaaaaaatttctaagtacccttacaatcgatggtgtcacacgatctgatcaaggactatacacatgtgccgcctcgagtggattaatgaccaagaagaattccacttttgtacgtgttcacgagaaggacaagacgcacacctgtccgccatgtcccgcacctgaactattgggaggtcccagtgtctttttattcccccccaagccgaaggatacgcttatgatttcgcgtacaccagaagtcacgtgtgtagttgtggatgtgtcacacgaggacccggaagtaaagtttaactggtatgtcgacggtgtcgaggttcataacgcaaagactaaaccacgagaagagcagtataactcgacatatcgtgtcgttagtgttttgacggtactacaccaagactggttaaacggtaaagagtacaagtgtaaggttagtaacaaggcattgccagctcccattgagaagactatcagtaaagctaagggtcaaccccgtgagccacaggtatacactcttcccccttcccgagacgagcttaccaagaaccaagtaagtcttacttgtttagtcaaaggattttacccgtctgatatcgctgtggagtgggaaagtaatggacagcccgaaaataattataagaccacaccccctgtactagattccgatggttcattctttttgtacagtaagttgactgttgataagagtcgttggcaacaaggtaatgtctttagttgcagtgtgatgcacgaggcattacacaaccactacactcagaagtcgttatcactatcgccaggc

SEQ ID NO: 83 - DNA, 6174 bp, synthetic construct
  misc_feature 1..6174: note = loxP-pEL-TurboFP635-loxP-pEL-IgK-scAb(VEGF-A fusion protein)-FLAG-terminator vector sequence
  misc_difference 972: note = n is a, c, g, or t
  misc_difference 974: note = n is a, c, g, or t
  source 1..6174: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacnnntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaaccgacacacttctattatgggtcctacttttgtgggttccaggttcaacaggagacagcgacactggacgaccgttcgttgagatgtattcggagataccggagataatccacatgactgaaggtcgagagttggtcattccgtgccgtgtgactagtccgaatattactgttacgcttaagaagttccctcttgatactttaatcccagacggtaagcgaatcatttgggactcccgaaagggtttcataatatccaatgctacatacaaagaaataggactattgacgtgtgaggccaccgtcaacggtcacctatacaagaccaattacttgacccatcgacagacgaatacgattattgatgtcgtactttcaccttcacatggtattgagttatccgtaggagagaaactagtcttaaattgtactgctcgaacggaattgaacgttggtatagatttcaactgggagtacccgagttcaaaacatcagcacaaaaagttagtcaaccgtgacttaaaaacccagagtggatcggaaatgaaaaaatttctaagtacccttacaatcgatggtgtcacacgatctgatcaaggactatacacatgtgccgcctcgagtggattaatgaccaagaagaattccacttttgtacgtgttcacgagaaggacaagacgcacacctgtccgccatgtcccgcacctgaactattgggaggtcccagtgtctttttattcccccccaagccgaaggatacgcttatgatttcgcgtacaccagaagtcacgtgtgtagttgtggatgtgtcacacgaggacccggaagtaaagtttaactggtatgtcgacggtgtcgaggttcataacgcaaagactaaaccacgagaagagcagtataactcgacatatcgtgtcgttagtgttttgacggtactacaccaagactggttaaacggtaaagagtacaagtgtaaggttagtaacaaggcattgccagctcccattgagaagactatcagtaaagctaagggtcaaccccgtgagccacaggtatacactcttcccccttcccgagacgagcttaccaagaaccaagtaagtcttacttgtttagtcaaaggattttacccgtctgatatcgctgtggagtgggaaagtaatggacagcccgaaaataattataagaccacaccccctgtactagattccgatggttcattctttttgtacagtaagttgactgttgataagagtcgttggcaacaaggtaatgtctttagttgcagtgtgatgcacgaggcattacacaaccactacactcagaagtcgttatcactatcgccaggcgactacaaagacgacgacgacaaataattaattaatttttatcgatctaattcaacaatgtctggattaattaatttttatcgatctaattcaacaatgtctggagcatgc

SEQ ID NO: 84 - DNA, 1389 bp, synthetic construct
  misc_feature 1..1389: note = Heavy chain of scAb(ANGPT2)
  source 1..1389: mol_type = other DNA
caggttcagctagtacaaagtggtgcggaggtgaagaaaccaggagcaagtgttaaggtcagttgtaaagcttccggatatacgttcactggttactacatgcactgggtgcgtcaggccccgggtcagggtttggaatggatgggttggattaacccgaactctggtggaacaaactatgcccagaaattccaaggaagagtcactatgacgagagacacttctatctccaccgcctatatggaactttcgcgattacgatcggatgatactgctgtctactactgtgcgagaagtccaaatccttactattacgattctagtggttattactacccgggagcattcgacatttggggtcaaggaacgatggtgacggtatcttcagcttctgttgctgcgccttcagtattcattttcccaccatctgacgaacaattgaaatctggaacagcgagtgtggtctgcctattaaacaacttttatcctcgtgaagcaaaggtacaatggaaggtagacaatgccttacaatcgggtaatagtcaggagtctgtcacagagcaggactccaaggattctacctactctcttagttccacgctaacattgtcgaaagctgactatgagaagcataaggtttatgcatgtgaagtaacgcaccaaggattgtcaagtccggtaacaaagtcctttaacagaggtgagtgtgataaaacgcacacctgcccgccatgtcccgcgcccgaattacttggtggtccctcagtgtttttatttcccccaaagccgaaagatacattgatgatttctcgaactcctgaagtaacgtgtgtagtagtggacgtatctcatgaggaccctgaagttaaatttaattggtatgttgacggtgtggaggtacacaacgcgaaaactaagcctcgtgaggaacaatacaactcgacgtatcgtgttgtttcggtattaacagtacttcaccaagattggttaaatggtaaggaatataaatgtaaggtatccaataaggcgcttccagcacctatcgaaaaaacaatatctaaggccaaaggacagccacgtgagccacaggtgtgtacattacccccctcccgagacgaacttaccaaaaatcaggtatccttgagttgtgcagtcaaaggtttctatccgtccgacatagcggtagaatgggaatcaaacggacaaccagagaacaactataaaactaccccaccggttctagattctgatggttcctttttcttggtctcaaagttaactgttgacaagtcccgttggcagcagggtaatgttttctcatgcagtgtgatgcacgaagcattacataaccattatacacaaaagtccttgtcgctaagtccgggaaag

SEQ ID NO: 85 - DNA, 639 bp, synthetic construct
  misc_feature 1..639: note = Light chain of scAb(ANGPT2)
  source 1..639: mol_type = other DNA
cagccgggacttactcagccgccttccgtgtccgtcgcgccaggtcagaccgctagaattacgtgtggaggaaacaacataggttctaagtcggttcactggtatcagcagaagccaggacaagctcctgtacttgttgtttatgacgactctgatcgaccatctggtattccagaacgtttttccggatccaactcaggaaatactgccacgttaacgatttcccgagtcgaagctggagatgaagccgattactactgccaggtatgggactcctcatccgaccactacgtgtttggtactggtactaaagtcacggttctaagttcagcctctacgaaaggaccctcggtcttcccactagcgccttcctcaaaatcgacttctggtggaactgcggcgttaggatgtcttgtgaaggattattttcccgagccggtgactgtttcttggaactccggagctttgacaagtggtgtccatacattcccggctgtgttgcaatcttctggattatattctcttagtagtgtggtaaccgttccgtcgtcgtctttgggaacacaaacctacatctgcaacgtcaaccacaagccctcgaatacaaaagtagacaagaaagtggaaccgaaatcgtgc

SEQ ID NO: 86 - DNA, 6954 bp, synthetic construct
  misc_feature 1..6954: note loxP-pEL-TurboFP635-loxP-pEL-IgK-scAb(ANGPT2)-FLAG-terminat or vector sequence
  variation 972: note = n is a, c, g, or t
  variation 974: note = n is a, c, g, or t
  source 1..6954: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacnnntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaaccgacacacttctattatgggtcctacttttgtgggttccaggttcaacaggagaccaggttcagctagtacaaagtggtgcggaggtgaagaaaccaggagcaagtgttaaggtcagttgtaaagcttccggatatacgttcactggttactacatgcactgggtgcgtcaggccccgggtcagggtttggaatggatgggttggattaacccgaactctggtggaacaaactatgcccagaaattccaaggaagagtcactatgacgagagacacttctatctccaccgcctatatggaactttcgcgattacgatcggatgatactgctgtctactactgtgcgagaagtccaaatccttactattacgattctagtggttattactacccgggagcattcgacatttggggtcaaggaacgatggtgacggtatcttcagcttctgttgctgcgccttcagtattcattttcccaccatctgacgaacaattgaaatctggaacagcgagtgtggtctgcctattaaacaacttttatcctcgtgaagcaaaggtacaatggaaggtagacaatgccttacaatcgggtaatagtcaggagtctgtcacagagcaggactccaaggattctacctactctcttagttccacgctaacattgtcgaaagctgactatgagaagcataaggtttatgcatgtgaagtaacgcaccaaggattgtcaagtccggtaacaaagtcctttaacagaggtgagtgtgataaaacgcacacctgcccgccatgtcccgcgcccgaattacttggtggtccctcagtgtttttatttcccccaaagccgaaagatacattgatgatttctcgaactcctgaagtaacgtgtgtagtagtggacgtatctcatgaggaccctgaagttaaatttaattggtatgttgacggtgtggaggtacacaacgcgaaaactaagcctcgtgaggaacaatacaactcgacgtatcgtgttgtttcggtattaacagtacttcaccaagattggttaaatggtaaggaatataaatgtaaggtatccaataaggcgcttccagcacctatcgaaaaaacaatatctaaggccaaaggacagccacgtgagccacaggtgtgtacattacccccctcccgagacgaacttaccaaaaatcaggtatccttgagttgtgcagtcaaaggtttctatccgtccgacatagcggtagaatgggaatcaaacggacaaccagagaacaactataaaactaccccaccggttctagattctgatggttcctttttcttggtctcaaagttaactgttgacaagtcccgttggcagcagggtaatgttttctcatgcagtgtgatgcacgaagcattacataaccattatacacaaaagtccttgtcgctaagtccgggaaagggaggaggtggttctggtggaggtggatccggaggaggtggttcgcagccgggacttactcagccgccttccgtgtccgtcgcgccaggtcagaccgctagaattacgtgtggaggaaacaacataggttctaagtcggttcactggtatcagcagaagccaggacaagctcctgtacttgttgtttatgacgactctgatcgaccatctggtattccagaacgtttttccggatccaactcaggaaatactgccacgttaacgatttcccgagtcgaagctggagatgaagccgattactactgccaggtatgggactcctcatccgaccactacgtgtttggtactggtactaaagtcacggttctaagttcagcctctacgaaaggaccctcggtcttcccactagcgccttcctcaaaatcgacttctggtggaactgcggcgttaggatgtcttgtgaaggattattttcccgagccggtgactgtttcttggaactccggagctttgacaagtggtgtccatacattcccggctgtgttgcaatcttctggattatattctcttagtagtgtggtaaccgttccgtcgtcgtctttgggaacacaaacctacatctgcaacgtcaaccacaagccctcgaatacaaaagtagacaagaaagtggaaccgaaatcgtgcgactacaaagacgacgacgacaaataattaattaatttttatcgatctaattcaacaatgtctggattaattaatttttatcgatctaattcaacaatgtctggagcatgc

SEQ ID NO: 87 - DNA, 1359 bp, synthetic construct
  misc_feature 1..1359: note = Heavy chain of scAb(VEGF-A)
  source 1..1359: mol_type = other DNA
gaggtacagttagtcgagagtggtggaggtttagtgcagccaggtggttcattgcgtctttcttgtgctgcttccggatacacgttcacaaactacggtatgaactgggtgagacaagccccgggaaaaggattggagtgggtcggatggatcaacacttacacgggtgaaccgacctatgctgcggatttcaagcgtcgatttactttctcacttgacacatctaagtcgacggcgtacctacagatgaactcccttcgtgccgaggatacggctgtctactactgcgctaaatatccgcactattacggatcatcccactggtactttgacgtttggggtcagggaacgttggtaacggtttcgagtgcctccacaaaaggaccttcagtctttccgcttgccccttcttcaaaatctactagtggaggtaccgcggctttaggatgcttagtgaaagattattttccggagccggtaaccgtctcatggaattcaggtgcccttacttcaggtgtacatacgttccccgccgttttacaatcttccggtttatattcattaagttccgtcgttaccgttccttcatcaagtctaggaactcaaacttatatatgtaacgtcaaccacaaacccagtaacacgaaagtagataaaaaggtcgaacctaaaagttgcgataagacccatacctgtcctccatgccccgccccggaacttctaggaggtcccagtgtcttccttttcccaccaaagccaaaggatacccttatgataagtcgtacgcctgaagtaacttgcgttgtggtcgacgtttcgcacgaagaccccgaagtgaaatttaattggtacgttgacggtgtggaggttcataacgctaagacaaagccacgtgaggaacaatataattccacataccgagtggtttcggtgctaaccgtattgcatcaggactggttgaatggtaaggaatacaagtgtaaagtaagtaataaagcattaccagcgccaatagaaaaaacgatttcaaaggccaagggacagcctagagagccgcaggtgtatacactacccccctgccgtgacgaacttacaaaaaatcaagtatcgttatggtgtttggtgaagggtttttatccttccgacatagccgtggagtgggagtctaacggacaaccggagaataattacaaaacaacacctccggtcctagacagtgatggatcgtttttcctatatagtaagcttactgttgataagtccagatggcaacagggaaacgtctttagttgttcagtgatgcacgaagcgttacacaatcactatacgcagaaaagtctatctctttctcccggaaag

SEQ ID NO: 88 - DNA, 642 bp, synthetic construct
  misc_feature 1..642: note = Light chain of scAb(VEGF-A)
  source 1..642: mol_type = other DNA
gacatccaaatgacacagtcgccttcctcactttcggctagtgttggagacagagtaaccatcacctgtagtgcctcacaagatatttccaattaccttaactggtaccagcagaagcccggtaaggctccgaaagtactaatctattttacttcctcgctacactccggagtcccttctcgtttctcaggatcaggatcgggtactgacttcacgttaactatatcgtccctacaaccggaggattttgccacctattactgtcagcagtattcgactgtcccttggaccttcggacagggaactaaggtggagattaaacgaacggtagctgcgccttcggtttttatatttccgccctcagatgagcagttaaagtccggaaccgcatctgtggtttgcttgcttaacaacttttatcccagagaggcgaaagtccaatggaaggttgacaatgcactacaatcgggaaatagtcaagaatctgtcacagagcaagattcgaaggattcaacgtattctctttcatcgactttaacattaagtaaggcagactacgaaaagcataaagtgtacgcttgcgaagtcactcatcagggtttgtcctccccagtaacgaagtcattcaatcgaggagagtgc

SEQ ID NO: 89 - DNA, 6927 bp, synthetic construct
  misc_feature 1..6927: note loxP-pEL-TurboFP635-loxP-pEL-IgK-scAb(VEGF-A)-FLAG-terminat or vector sequence
  variation 972: note = n is a, c, g, or t
  variation 974: note = n is a, c, g, or t
  source 1..6927: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacndntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaaccgacacacttctattatgggtcctacttttgtgggttccaggttcaacaggagacgaggtacagttagtcgagagtggtggaggtttagtgcagccaggtggttcattgcgtctttcttgtgctgcttccggatacacgttcacaaactacggtatgaactgggtgagacaagccccgggaaaaggattggagtgggtcggatggatcaacacttacacgggtgaaccgacctatgctgcggatttcaagcgtcgatttactttctcacttgacacatctaagtcgacggcgtacctacagatgaactcccttcgtgccgaggatacggctgtctactactgcgctaaatatccgcactattacggatcatcccactggtactttgacgtttggggtcagggaacgttggtaacggtttcgagtgcctccacaaaaggaccttcagtctttccgcttgccccttcttcaaaatctactagtggaggtaccgcggctttaggatgcttagtgaaagattattttccggagccggtaaccgtctcatggaattcaggtgcccttacttcaggtgtacatacgttccccgccgttttacaatcttccggtttatattcattaagttccgtcgttaccgttccttcatcaagtctaggaactcaaacttatatatgtaacgtcaaccacaaacccagtaacacgaaagtagataaaaaggtcgaacctaaaagttgcgataagacccatacctgtcctccatgccccgccccggaacttctaggaggtcccagtgtcttccttttcccaccaaagccaaaggatacccttatgataagtcgtacgcctgaagtaacttgcgttgtggtcgacgtttcgcacgaagaccccgaagtgaaatttaattggtacgttgacggtgtggaggttcataacgctaagacaaagccacgtgaggaacaatataattccacataccgagtggtttcggtgctaaccgtattgcatcaggactggttgaatggtaaggaatacaagtgtaaagtaagtaataaagcattaccagcgccaatagaaaaaacgatttcaaaggccaagggacagcctagagagccgcaggtgtatacactacccccctgccgtgacgaacttacaaaaaatcaagtatcgttatggtgtttggtgaagggtttttatccttccgacatagccgtggagtgggagtctaacggacaaccggagaataattacaaaacaacacctccggtcctagacagtgatggatcgtttttcctatatagtaagcttactgttgataagtccagatggcaacagggaaacgtctttagttgttcagtgatgcacgaagcgttacacaatcactatacgcagaaaagtctatctctttctcccggaaagggaggaggtggttctggtggaggtggatccggaggaggtggttcggacatccaaatgacacagtcgccttcctcactttcggctagtgttggagacagagtaaccatcacctgtagtgcctcacaagatatttccaattaccttaactggtaccagcagaagcccggtaaggctccgaaagtactaatctattttacttcctcgctacactccggagtcccttctcgtttctcaggatcaggatcgggtactgacttcacgttaactatatcgtccctacaaccggaggattttgccacctattactgtcagcagtattcgactgtcccttggaccttcggacagggaactaaggtggagattaaacgaacggtagctgcgccttcggtttttatatttccgccctcagatgagcagttaaagtccggaaccgcatctgtggtttgcttgcttaacaacttttatcccagagaggcgaaagtccaatggaaggttgacaatgcactacaatcgggaaatagtcaagaatctgtcacagagcaagattcgaaggattcaacgtattctctttcatcgactttaacattaagtaaggcagactacgaaaagcataaagtgtacgcttgcgaagtcactcatcagggtttgtcctccccagtaacgaagtcattcaatcgaggagagtgcgactacaaagacgacgacgacaaataattaattaatttttatcgatctaattcaacaatgtctggattaattaatttttatcgatctaattcaacaatgtctggagcatgc

SEQ ID NO: 90 - DNA, 9187 bp, synthetic construct
  misc_feature 1..9187: note loxP-pEL-TurboFP635-loxP-pEL-IgK-scAb(VEGF-A)-FLAG-terminat or- terminator-FLAG-scAb(ANGPT2)-IgK-pEL vector sequence
  variation 972: note = n is a, c, g, or t
  variation 974: note = n is a, c, g, or t
  source 1..9187: mol_type = other DNA
ggccgcgagctcaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagacacgtgggcgcccctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacnnntacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaaagcttcaattgctgcaggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcggagctcccatgggctagcataacttcgtatagcatacattatacgaagttatactagtcccggggctagcaaaaattgaaattttattttttttttttggaatataaataagctcgaagtcgaccaccatggtgggtgaggatagcgtgctgatcaccgagaacatgcacatgaaactgtacatggagggcaccgtgaacgaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaaacctttatcaaccacacccagggcatccccgacttctttaagcagtccttccctgagggcttcacatgggagaggatcaccacatacgaagacgggggcgtgctgaccgctacccaggacaccagcctccagaacggctgcctcatctacaacgtcaagatcaacggggtgaacttcccatccaacggccctgtgatgcagaagaaaacactcggctgggaggccagcaccgagatgctgtaccccgctgacagcggcctgagaggccatagccagatggccctgaagctcgtgggcgggggctacctgcactgctccctcaagaccacatacagatccaagaaacccgctaagaacctcaagatgcccggcttctacttcgtggacaggagactggaaagaatcaaggaggccgacaaagagacctacgtcgagcagcacgagatggctgtggccaggtactgcgacctgcctagcaaactggggcacagctgattaattaatttttatcgatctaattcaacaatgtctggaaccggtcttaagataacttcgtatagcatacattatacgaagttatggatccgcatgcaaaaattgaaattttattttttttttttggaatataaataagctcgaagtcgaccaccatggaaaccgacacacttctattatgggtcctacttttgtgggttccaggttcaacaggagacgaggtacagttagtcgagagtggtggaggtttagtgcagccaggtggttcattgcgtctttcttgtgctgcttccggatacacgttcacaaactacggtatgaactgggtgagacaagccccgggaaaaggattggagtgggtcggatggatcaacacttacacgggtgaaccgacctatgctgcggatttcaagcgtcgatttactttctcacttgacacatctaagtcgacggcgtacctacagatgaactcccttcgtgccgaggatacggctgtctactactgcgctaaatatccgcactattacggatcatcccactggtactttgacgtttggggtcagggaacgttggtaacggtttcgagtgcctccacaaaaggaccttcagtctttccgcttgccccttcttcaaaatctactagtggaggtaccgcggctttaggatgcttagtgaaagattattttccggagccggtaaccgtctcatggaattcaggtgcccttacttcaggtgtacatacgttccccgccgttttacaatcttccggtttatattcattaagttccgtcgttaccgttccttcatcaagtctaggaactcaaacttatatatgtaacgtcaaccacaaacccagtaacacgaaagtagataaaaaggtcgaacctaaaagttgcgataagacccatacctgtcctccatgccccgccccggaacttctaggaggtcccagtgtcttccttttcccaccaaagccaaaggatacccttatgataagtcgtacgcctgaagtaacttgcgttgtggtcgacgtttcgcacgaagaccccgaagtgaaatttaattggtacgttgacggtgtggaggttcataacgctaagacaaagccacgtgaggaacaatataattccacataccgagtggtttcggtgctaaccgtattgcatcaggactggttgaatggtaaggaatacaagtgtaaagtaagtaataaagcattaccagcgccaatagaaaaaacgatttcaaaggccaagggacagcctagagagccgcaggtgtatacactacccccctgccgtgacgaacttacaaaaaatcaagtatcgttatggtgtttggtgaagggtttttatccttccgacatagccgtggagtgggagtctaacggacaaccggagaataattacaaaacaacacctccggtcctagacagtgatggatcgtttttcctatatagtaagcttactgttgataagtccagatggcaacagggaaacgtctttagttgttcagtgatgcacgaagcgttacacaatcactatacgcagaaaagtctatctctttctcccggaaagggaggaggtggttctggtggaggtggatccggaggaggtggttcggacatccaaatgacacagtcgccttcctcactttcggctagtgttggagacagagtaaccatcacctgtagtgcctcacaagatatttccaattaccttaactggtaccagcagaagcccggtaaggctccgaaagtactaatctattttacttcctcgctacactccggagtcccttctcgtttctcaggatcaggatcgggtactgacttcacgttaactatatcgtccctacaaccggaggattttgccacctattactgtcagcagtattcgactgtcccttggaccttcggacagggaactaaggtggagattaaacgaacggtagctgcgccttcggtttttatatttccgccctcagatgagcagttaaagtccggaaccgcatctgtggtttgcttgcttaacaacttttatcccagagaggcgaaagtccaatggaaggttgacaatgcactacaatcgggaaatagtcaagaatctgtcacagagcaagattcgaaggattcaacgtattctctttcatcgactttaacattaagtaaggcagactacgaaaagcataaagtgtacgcttgcgaagtcactcatcagggtttgtcctccccagtaacgaagtcattcaatcgaggagagtgcgactacaaagacgacgacgacaaataattaattaatttttatcgatctaattcaacaatgtctggattaattaatttttatcgatcttccagacattgttgaattagatcgataaaaattaattaattatttgtcgtcgtcgtctttgtagtcgcacgatttcggttccactttcttgtctacttttgtattcgagggcttgtggttgacgttgcagatgtaggtttgtgttcccaaagacgacgacggaacggttaccacactactaagagaatataatccagaagattgcaacacagccgggaatgtatggacaccacttgtcaaagctccggagttccaagaaacagtcaccggctcgggaaaataatccttcacaagacatcctaacgccgcagttccaccagaagtcgattttgaggaaggcgctagtgggaagaccgagggtcctttcgtagaggctgaacttagaaccgtgactttagtaccagtaccaaacacgtagtggtcggatgaggagtcccatacctggcagtagtaatcggcttcatctccagcttcgactcgggaaatcgttaacgtggcagtatttcctgagttggatccggaaaaacgttctggaataccagatggtcgatcagagtcgtcataaacaacaagtacaggagcttgtcctggcttctgctgataccagtgaaccgacttagaacctatgttgtttcctccacacgtaattctagcggtctgacctggcgcgacggacacggaaggcggctgagtaagtcccggctgcgaaccacctcctccggatccacctccaccagaaccacctcctccctttcccggacttagcgacaaggacttttgtgtataatggttatgtaatgcttcgtgcatcacactgcatgagaaaacattaccctgctgccaacgggacttgtcaacagttaactttgagaccaagaaaaaggaaccatcagaatctagaaccggtggggtagttttatagttgttctctggttgtccgtttgattcccattctaccgctatgtcggacggatagaaacctttgactgcacaactcaaggatacctgatttttggtaagttcgtctcgggaggggggtaatgtacacacctgtggctcacgtggctgtcctttggccttagatattgttttttcgataggtgctggaagcgccttattggataccttacatttatattccttaccatttaaccaatcttggtgaagtactgttaataccgaaacaacacgatacgtcgagttgtattgttcctcacgaggcttagttttcgcgttgtgtacctccacaccgtcaacataccaattaaatttaacttcagggtcctcatgagatacgtccactactacacacgttacttcaggagttcgagaaatcatcaatgtatctttcggctttgggggaaataaaaacactgagggaccaccaagtaattcgggcgcgggacatggcgggcaggtgtgcgttttatcacactcacctctgttaaaggactttgttaccggacttgacaatccttggtgcgttacttcacatgcataaaccttatgcttctcatagtcagctttcgacaatgttagcgtggaactaagagagtaggtagaatccttggagtcctgctctgtgacagactcctgactattacccgattgtaaggcattgtctaccttccattgtacctttgcttcacgaggataaaagttgtttaataggcagaccacactcgctgttccagatttcaattgttcgtcagatggtgggaaaatgaatactgaaggcgcagcaacagaagctgaagataccgtcaccatcgttccttgaccccaaatgtcgaatgctcccgggtagtaataaccactagaatcgtaatagtaaggatttggacttctcgcacagtagtagacagcagtatcatccgatcgtaatcgcgaaagttccatataggcggtggagatagaagtgtctctcgtcatagtgactcttccttggaatttctgggcatagtttgttccaccagagttcgggttaatccaacccatccattccaaaccctgacccggggcctgacgcacccagtgcatgtagtaaccagtgaacgtatatccggaagctttacaactgaccttaacacttgctcctggtttcttcacctccgcaccactttgtactagctgaacctggtctcctgttgaacctggaacccacaaaagtaggacccataatagaagtgtgtcggtttccatggtggtcgacttcgagcttatttatattccaaaaaaaaaaaataaaatttcaatttttaattcaacaatgtctggagcatgc

SEQ ID NO: 91 - DNA, 26 bp, synthetic construct
  misc_feature 1..26: note = A56R Forward Primer
  source 1..26: mol_type = other DNA
catcatctggaattgtcactactaaa

SEQ ID NO: 92 - DNA, 23 bp, synthetic construct
  misc_feature 1..23: note = A56R Reverse Primer
  source 1..23: mol_type = other DNA
acggccgacaatataattaatgc

SEQ ID NO: 93 - DNA, 20 bp, synthetic construct
  misc_feature 1..20: note = GAPDH1 Forward Primer
  source 1..20: mol_type = other DNA
gggaaggtgaaggtcggagt

SEQ ID NO: 94 - DNA, 25 bp, synthetic construct
  misc_feature 1..25: note = GAPDH1 Reverse Primer
  source 1..25: mol_type = other DNA
tccactttaccagagttaaaagcag

SEQ ID NO: 95 - DNA, 20 bp, synthetic construct
  misc_feature 1..20: note = Guide RNA (gRNA1, SEQ ID NO:1) target sequence
  source 1..20: mol_type = other DNA
cgaggaaaagctgtagttat

What is claimed:

1. A cell-assisted viral expression system (CAVES), comprising a carrier cell and an oncolytic virus, wherein:

the carrier cell comprising the oncolytic virus was produced by infection of the cell with virus at a low MOI, followed by incubation for sufficient time under conditions in which proteins encoded by the virus are expressed, whereby:

the carrier cell expresses at least one immunomodulatory protein encoded by the virus by virtue of association of the virus with the carrier cell, but by virtue of the low MOI the virus does not lyse the cell; and the carrier cell is not a tumor cell.

2. The cell-assisted viral expression system (CAVES) of claim 1, wherein the carrier cell is an immune cell, or a stem cell.

3. The cell-assisted viral expression system (CAVES) of claim 1, wherein the oncolytic virus is selected from among a poxvirus, adenovirus, herpes simplex virus, Newcastle disease virus, vesicular stomatitis virus, measles virus, reovirus, cytomegalovirus (CMV), and lentivirus.

4. The cell-assisted viral expression system (CAVES) of claim 1, wherein the oncolytic virus is selected from among a parvovirus, picornavirus, rhabdovirus, alphavirus, Maraba virus, and retrovirus.

5. The cell-assisted viral expression system (CAVES) of claim 1, wherein the virus is a vaccinia virus.

6. The cell-assisted viral expression system (CAVES) of claim 5, wherein the incubation is effected for 2 more hours; and the MOI is less than 0.5.

7. The cell-assisted viral expression system (CAVES) of claim 5, wherein the vaccinia virus is thymidine kinase (TK).

8. The cell-assisted viral expression system (CAVES) of claim 5, wherein the vaccinia virus contains a mutation in the A34R protein for enhanced extracellular enveloped virus (EEV) production.

9. The cell-assisted viral expression system (CAVES) of claim 5, wherein the vaccinia virus is selected from among ACAM1000, ACAM2000, Lister, EM63, LIVP, Tian Tan, Copenhagen, Western Reserve, Modified Vaccinia Ankara (MVA), New York City Board of Health, Dairen, Ikeda, LC16M8, Tashkent, Wyeth, IHD-J, IHD-W, Brighton, Dairen I and Connaught strains.

10. The cell-assisted viral expression system (CAVES) of claim 5, wherein the vaccinia virus is an ACAM1000 virus, an ACAM2000 virus, or a virus propagated from an ACAM1000 or ACAM2000 virus.

11. The cell-assisted viral expression system (CAVES) of claim 10, wherein the genome of the virus comprises the sequence of nucleotides set forth in SEQ ID NO: 71.

12. The cell-assisted viral expression system (CAVES) of claim 5, wherein the virus is a vaccinia virus that has a deletion or insertion in FIL and/or B8R and/or A52R, whereby the virus is attenuated.

13. The cell-assisted viral expression system (CAVES) of claim 1, wherein the carrier cell is a stem cell selected from among adult stem cells; embryonic stem cells; fetal stem cells; neural stem cells; mesenchymal stem cells; totipotent stem cells; pluripotent stem cells; induced pluripotent stem cells; multipotent stem cells; oligopotent stem cells; unipotent stem cells; adipose stromal stem cells; endothelial stem cells adult peripheral blood stem cells; myoblasts; small juvenile stem cells; skin fibroblast stem cells; tissue/tumor-associated fibroblasts; epithelial stem cells; and embryonic epithelial stem cells.

14. The cell-assisted viral expression system (CAVES) of claim 1, wherein the carrier cell is a stem cell.

15. The cell-assisted viral expression system (CAVES) of claim 14, wherein the stem cell is a mesenchymal stem cell (MSC).

16. The cell-assisted viral expression system (CAVES) of claim 14, wherein the stem cell is an adipose stromal stem cell.

17. The cell-assisted viral expression system (CAVES) of claim 16, wherein the adipose stromal stem cells are selected from supra adventitial-adipose stromal cells (SA-ASC; CD235a−/CD45−/CD34+/CD146−/CD31−) and pericytes (CD235a−/CD45−/CD34−/CD146+/CD31−).

18. The cell-assisted viral expression system (CAVES) of claim 1, wherein:

the carrier cell has been treated or modified or both to enhance the immunosuppressive properties and/or immunoprivileged properties of the cell for administration to a human subject; and optionally, the cell has been treated or modified to enhance amplification of the virus in the cell.

19. The cell-assisted viral expression system (CAVES) of claim 18, wherein the carrier cell is engineered to express an oncogene and/or tumor suppressor.

20. The cell-assisted viral expression system (CAVES) of claim 19, wherein the carrier cell is engineered to express one or more of myc, Rb, Ras, p53, and telomerase.

21. The cell-assisted viral expression system (CAVES) of claim 1 produced by incubating the carrier cell with the virus for at least 16 hours.

22. The cell-assisted viral expression system (CAVES) of claim 21 produced by incubating the carrier cell with the virus for at least 20 hours.

23. The cell-assisted viral expression system (CAVES) of claim 21 produced by incubating the carrier cell with the virus for at least 24 hours.

24. The cell-assisted viral expression system (CAVES) of claim 1 produced by incubating the carrier cell with the virus for up to 48 hours.

25. A cryopreserved composition, comprising the cell-assisted viral expression system (CAVES) of claim 1.

26. A method of treatment of a subject who has a tumor or hematological malignancy, comprising:

providing the cell-assisted viral expression system (CAVES) of the cryopreserved composition of claim 25 in medium for administration to the subject; and administering a therapeutically effective amount of the resulting composition cell-assisted viral expression system (CAVES) to the subject.

27. The method of claim 26, wherein the cell-assisted viral expression system (CAVES) is systemically administered.

28. The cell-assisted viral expression system (CAVES) of claim 27, wherein the carrier cell is modified to express one or more of c-myc, v-myc, E6/E7, hTERT, wild type or modified SV40 large tumor antigen, loxP and/or tetR.

29. The cell-assisted viral expression system (CAVES) of claim 1, wherein the virus encodes a therapeutic product for treating a tumor.

30. The cell-assisted viral expression system (CAVES) of claim 29, wherein the therapeutic product reprograms tumor blood vessels to facilitate T-cell infiltration in the tumor microenvironment or into tumors.

31. A method of treatment of a subject who has cancer, comprising administering a cell-assisted viral expression system (CAVES) of claim 1.

32. The method of claim 31, wherein the cell-assisted viral expression system (CAVES) is systemically administered.

33. The method of claim 32, wherein the cell-assisted viral expression system (CAVES) is administered intravenously.

34. The method of claim 31, wherein the cell-assisted viral expression system (CAVES) is administered intratumorally or intraperitoneally.

35. The method of claim 34, wherein the carrier cell of the cell-assisted viral expression system (CAVES) is a neural stem cell.

36. The method of claim 34, further comprising administering another anti-cancer agent or treatment.

37. The method of claim 36, wherein the further treatment is administration of a checkpoint inhibitor or CAR-T cells or TIL cells.

38. The method of claim 31, wherein the oncolytic virus of the cell-assisted viral expression system (CAVES) is a vaccinia virus.

39. The method of claim 31, wherein the cancer is selected from among a bladder tumor, breast tumor, prostate tumor, carcinoma, basal cell carcinoma, biliary tract cancer, bladder cancer, bone cancer, brain cancer, central nervous system (CNS) cancer, glioma tumor, cervical cancer, choriocarcinoma, colon cancer, connective tissue cancer, cancer of the digestive system, endometrial cancer, esophageal cancer, eye cancer, cancer of the head and neck, gastric cancer, intra-epithelial neoplasm, kidney cancer, larynx cancer, leukemia, liver cancer, lung cancer, lymphoma, Hodgkin's lymphoma, Non-Hodgkin's lymphoma, melanoma, myeloma, neuroblastoma, oral cavity cancer, ovarian cancer, pancreatic cancer, retinoblastoma, rhabdomyosarcoma, rectal cancer, renal cancer, cancer of the respiratory system, sarcoma, skin cancer, stomach cancer, testicular cancer, thyroid cancer, uterine cancer, cancer of the urinary system, lymphosarcoma, osteosarcoma, mammary tumors, mastocytoma, brain tumor, adenosquamous carcinoma, carcinoid lung tumor, bronchial gland tumor, bronchiolar adenocarcinoma, small cell lung cancer, non-small cell lung cancers, fibroma, myxochondroma, pulmonary sarcoma, neurosarcoma, osteoma, papilloma, retinoblastoma, Ewing's sarcoma, Wilm's tumor, Burkitt's lymphoma, microglioma, osteoclastoma, oral neoplasia, fibrosarcoma, genital squamous cell carcinoma, transmissible venereal tumor, testicular tumor, seminoma, Sertoli cell tumor, hemangiopericytoma, histiocytoma, chloroma, granulocytic sarcoma, corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma, cystadenoma, follicular lymphoma, intestinal lymphosarcoma, pulmonary squamous cell carcinoma, hemangiopericytoma, ocular neoplasia, preputial fibrosarcoma, ulcerative squamous cell carcinoma, preputial carcinoma, connective tissue neoplasia, hepatocellular carcinoma, pulmonary adenomatosis, pulmonary sarcoma, Rous sarcoma, reticulo-endotheliosis, nephroblastoma, B-cell lymphoma, lymphoid leukosis, retinoblastoma, hepatic neoplasia, lymphosarcoma, plasmacytoid leukemia, swimbladder sarcoma (in fish), caseous lymphadenitis, lung carcinoma, insulinoma, neuroma, pancreatic islet cell tumor, gastric MALT lymphoma and gastric adenocarcinoma.

40. The method of claim 31, wherein the carrier cell of the cell-assisted viral expression system (CAVES) is allogeneic to the subject.

41. The method of claim 31, wherein:

the carrier cell of the cell-assisted viral expression system (CAVES) is a stem cell; and the oncolytic virus of the cell-assisted viral expression system (CAVES) is a vaccinia virus.

42. A method of producing a cell-assisted viral expression system (CAVES) of claim 1, comprising:

infecting carrier cells with the virus at the low MOI;

incubating the carrier cells and the oncolytic virus for a time sufficient for the virus to express encoded proteins, whereby the carrier cells express at least one immunomodulatory protein or recombinant therapeutic protein encoded by the virus by virtue of association of the virus with the carrier cells to produce a cell-assisted viral expression system (CAVES), but are not lysed by the virus;

recovering the cell-assisted viral expression system cells; and storing them at reduced temperature in cryopreservation medium to produce stored cell-assisted viral expression systems (CAVES).

43. A pharmaceutical composition, comprising in a pharmaceutically acceptable vehicle, a cell-assisted viral expression system (CAVES) of claim 1.

44. The pharmaceutical composition of claim 43, wherein the oncolytic virus is selected from among a poxvirus, adenovirus, herpes simplex virus, Newcastle disease virus, vesicular stomatitis virus, measles virus, reovirus, cytomegalovirus (CMV), and lentivirus.

* * * * *